US011920177B2

(12) United States Patent
Vemuri et al.

(10) Patent No.: US 11,920,177 B2
(45) **Date of Patent: *Mar. 5, 2024**

(54) SYNTHESIS OF BETA-HYDROXYISOVALERATE AND METHODS OF USE

(71) Applicant: Sasya Inc., St. Paul, MN (US)

(72) Inventors: Goutham Vemuri, Maple Grove, MN (US); Christopher Lindsay, St. Paul, MN (US); Kevin Roberg-Perez, Minneapolis, MN (US); Christopher D. Snow, St. Paul, MN (US); Elizabeth A. Cameron, New Brighton, MN (US)

(73) Assignee: SASYA INC., St. Paul, MN (US)

(*) Notice: Subject to any disclaimer, the term of this patent is extended or adjusted under 35 U.S.C. 154(b) by 0 days.

This patent is subject to a terminal disclaimer.

(21) Appl. No.: 17/658,217

(22) Filed: Apr. 6, 2022

(65) Prior Publication Data

US 2022/0315954 A1 Oct. 6, 2022

Related U.S. Application Data

(60) Provisional application No. 63/171,418, filed on Apr. 6, 2021.

(51) Int. Cl.
*C12P 7/16* (2006.01)
*C12N 1/20* (2006.01)
(Continued)

(52) U.S. Cl.
CPC .................. *C12P 7/16* (2013.01); *C12N 1/20* (2013.01); *C12N 9/0006* (2013.01); *C12N 9/88* (2013.01);
(Continued)

(58) Field of Classification Search
CPC ..... C12P 7/16; C12P 7/42; C12N 1/20; C12N 9/0006; C12N 9/88; C12N 15/52;
(Continued)

(56) References Cited

FOREIGN PATENT DOCUMENTS

| | | | | | |
|---|---|---|---|---|---|
| CN | 109251940 A | * | 1/2019 | .......... | C12N 15/902 |
| WO | WO-2011032934 A1 | * | 3/2011 | .......... | C12N 9/1025 |

OTHER PUBLICATIONS

Griswold, A. (2008) Genome packaging in prokaryotes: the circular chromosome of *E. coli*. Nature Education 1(1):57 (Year: 2008).*

(Continued)

*Primary Examiner* — Lora E Barnhart Driscoll
*Assistant Examiner* — Candice Lee Swift
(74) *Attorney, Agent, or Firm* — DeWitt LLP

(57) ABSTRACT

The biological production of beta-hydroxyisovalerate (βHIV) using a non-natural microorganism. The non-natural microorganism for the biologically-derived βHIV provides more beta-hydroxyisovalerate synthase activity than the wild-type parent. The non-natural microorganism can host a non-natural enzyme, such as the non-natural enzyme expressed in a yeast or bacteria, wherein the non-natural microorganism comprises an active βHIV metabolic pathway for the production of βHIV. The biological derivation of βHIV eliminates toxic by-products and impurities that result from the chemical production of βHIV, such that βHIV produced by a non-natural microorganism prior to any isolation or purification process has not been in substantial contact with any halogen-containing component.

23 Claims, 5 Drawing Sheets

Specification includes a Sequence Listing.

(51) Int. Cl.
*C12N 9/04* (2006.01)
*C12N 9/88* (2006.01)
*C12N 15/52* (2006.01)

(52) U.S. Cl.
CPC ...... *C12N 15/52* (2013.01); *C12Y 101/01086* (2013.01)

(58) Field of Classification Search
CPC .. C12N 9/0069; C12N 9/1022; C12N 9/1025; C12Y 101/01086; C12Y 101/01085; C12Y 202/01006; C12Y 203/03013; C12Y 402/01009; C12Y 402/01033; C12Y 113/11027; C12R 2001/15; C12R 2001/645; C12R 2001/84
See application file for complete search history.

(56) References Cited

OTHER PUBLICATIONS

Gao, Ruichen, and Zhimin Li. "Biosynthesis of 3-hydroxy-3-methylbutyrate from I-leucine by whole-cell catalysis." Journal of Agricultural and Food Chemistry 69.12 (2021): 3712-3719. (Year: 2021).*

Kyoto Encyclopedia of Genes and Genomes, Butanoate Metabolism; https://www.genome.jp/pathway/sce00650; accessed Mar. 29, 2023 (Year: 2023).*

Schoch CL, et al. NCBI Taxonomy: a comprehensive update on curation, resources and tools. Database (Oxford). 2020: baaa062. PubMed: 32761142 PMC: PMC7408187. (Year: 2023).*

* cited by examiner

SYNTHESIS OF BETA-HYDROXYISOVALERATE AND METHODS OF USE

PRIORITY CLAIM

This application claims the benefit of U.S. Provisional Application No. 63/171,418, filed Apr 6, 2021, which is hereby incorporated by reference in its entirety.

FIELD OF THE INVENTION

The present disclosure generally relates to biological processes of producing beta hydroxyisovalerate, more particularly methods to create non-natural microorganisms comprising non-natural βHIV synthase enzymes and processes for using said microorganisms to produce beta hydroxyisovalerate, and more specifically to non-natural microorganisms that produce beta hydroxyisovalerate.

BACKGROUND

The beta hydroxyisovalerate (βHIV) molecule (shown below), which is also known as 3-hydroxy-3-methylbutric acid, has potential applications ranging from liquid crystals to pharmaceutical ingredients and dietary supplements.

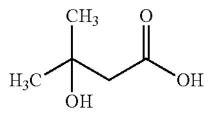

As such, a number of methods to produce β-hydroxyisovalerate are known in the art. They are mainly centered around chemical, organic synthesis starting with 4-hydroxy-4-methyl-2-pentanone. βHIV can be synthesized by the oxidation of 4-hydroxy-4-methyl-2-pentanone. One suitable procedure is described by Coffman et al., J. Am. Chem. Soc. 80: 2882-2887 (1958). See also, for example, U.S. Pat. Nos. 6,248,922, 6,090,978 US 1016471653, U.S. Pat. No. 6,090,918 and US2014025698. As described therein, βHIV is synthesized by an alkaline sodium hypochlorite oxidation of diacetone alcohol. The product is recovered in free acid form, which can be converted to a salt. For example, βHIV can be prepared as its calcium salt by a procedure similar to that of Coffman et al. (1958) in which the free acid of βHIV is neutralized with calcium hydroxide and recovered by crystallization from an aqueous ethanol solution.

Biological methods to produce βHIV are also known. For example, βHIV can also be prepared by the conversion of 3-methylcrotonate (3-methylbut-2-enoate) by cell-free extracts of *Galactomyces reessii* [Dhar and J P N Rosazza. Journal of Industrial Microbiology & Biotechnology 2002, 28, 81-87]. Cell free extracts of *Galactomyces reessii* contain an enoyl CoA hydratase that can catalyze the transformation of 3-methylcrotonic acid to βHIV. Resting cells of *Galactomyces reessii* could convert β-methylbutyrate into β-hydroxyisovalerate [Lee I Y, Nissen S L, Rosazza J P. Applied and environmental microbiology 1997, 63(11): 4191-4195; Lee I Y, Rosazza J P. Arch. Microbiol., 1998 Mar;169(3):257-62]. Using a two-step fed-batch fermentation process where biomass was first produced to sufficient density in the first step, followed by the addition of β-methylbutyrate to the washed biomass in the second step, Lee et al. reported producing 38 g/L of βHIV. U.S. Pat. No. 10,676,765B2 describes an alternative enzymatic method to produce βHIV through the conversion of 3-methylcrotonyl-CoA into βHIV via 3-hydroxy-3-methylbutyryl-CoA. The availability of 3-methylcrotonic acid or β-methylbutyrate in economically viable quantities for in vitro or in vivo production of βHIV is still a challenge that needs to be overcome before this process can become commercially viable.

Indeed, βHIV is synthesized in humans through the metabolism of L-leucine (see for example Nutrient Metabolism, Martin Kohlmeier, Academic Press, 2015) as a result of the conversion of its keto acid, α-ketoisocaproate (KIC) by the promiscuous action of 4-hydroxyphenylpyruvate dioxygenase (HPPD). Dioxygenases are enzymes that incorporate diatomic oxygen to form oxo-intermediates. To reduce diatomic oxygen, these enzymes require a source of electrons as well as a cofactor capable of one-electron chemistry. The ferrous ion is the most common cofactor capable of localizing substrates by acting as a conduit to transfer the electrons from the substrates to oxygen. Common coordinated reductant for the ferrous ion is the α-keto acid moiety and α-keto acid dependent oxygenases are very versatile and play a key role in the secondary metabolism [Purpero and Moran, J. Biol. Inorg. Chem. 12 (2007) 587-601].

A majority of the α-keto acid dependent oxygenases have three substrates—oxygen, α-ketoglutarate (the source of the α-keto acid) and the substrate, whose transformation is the catalytic objective [Hausinger, Crit. Rev. Biochem. Mol. Biol. 39 (2004) 21-68]. HPPD and hydroxymandelate synthase (HMS) are an exception to this general principal by having only two substrates. HPPD and HMS receive electrons from their common α-keto acid substrate, 4-hydroxyphenylpyruvate (HPP), and also transform it into their hydroxylated and decarboxylated products homogentisate and hydroxymandelate, respectively, without the need for α-ketoglutarate. These two enzymes are believed to have evolved from an entirely different lineage than all other α-keto acid oxygenases [Moran, G. M., Archives of Biochemistry and Biophysics 544 (2014) 58-68] although their core catalytic mechanism is consistent with the enzyme family.

There is a large body of literature on HPPD, owing to its importance in agriculture and medicine. The primary product of HPPD reaction is homogentisate, which is the precursor to plastoquinone and tocopherols in plants and archaea. They are intimately involved in electron transport in the photosynthetic system, serve as antioxidants and plant hormones. Therefore, inhibiting the synthesis of homogentisate is commonly used to inhibit the growth of plants and weeds. A number of molecules such as leptospermone and usnic acid and their similars inhibit HPPD activity and are used as ingredients in herbicides [Beaudegnies et al., Bioorg. Med. Chem. 17 (2009) 4134-4152]. HPPD inhibitors such as NTBC (nitisinone) is used to treat Type 1 tyrosinemia. Inborn genetic errors leading to aberrant metabolic enzymes in the catabolism of homogentisate causes Type 1 tyrosinemia. NTBC has been used as a treatment by repressing the synthesis of homogentisate by inhibiting HPPD [Lindstedt et al., Lancet 340 (1992) 813-817].

Interestingly, HPPD was also shown to produce βHIV as a result of its promiscuity towards α-ketoisocaproate, the keto acid of leucine [Crouch N P, E. Baldwin, M.-H. Lee, C. H. MacKinnon, Z. H. Zhang, Bioorg Med Chem Lett 1996, 6(13):1503-1506]. In addition to its involvement in aromatic amino acid metabolism, HPPD is involved in the metabolism of leucine by converting excess α-ketoisocaproate into βHIV [Crouch N P, Lee M H, Iturriagagoitia-Bueno T, MacKinnon C H. Methods in enzymology 2000, 324:342-355]. Prior to the elucidation of the promiscuity of HPPD, a dedicated dioxygenase to transform α-ketoisocaproate into βHIV was alleged to exist [Sabourin P J, Bieber L L: The Journal of biological chemistry 1982, 257(13):7468-7471; Sabourin P J, Bieber L L: Methods in enzymology 1988, 166:288-297; Sabourin P J, Bieber L L: Metabolism: clinical and experimental 1983, 32(2):160-164; Xu et al., Biochemical and Biophysical Research Communications 276, (2000), 1080-1084]. Baldwin et al., (1995) published early reports of HPPD having several fold higher activity with HPP than with α-ketoisocaproate [Baldwin et al., Bioorganic and Medicinal Chemistry Letters, 5(12) (1995), 1255-1260]. Subsequently, sequence studies and further biochemical analyses by Crouch et al, (1996) and Crouch et al., (2000) confirmed that the alleged dioxygenase was HPPD which catalyzed the conversion of α-ketoisocaproate into βHIV as a result of its promiscuity. Indeed, Crouch et al., 1996 suggested any further reference to HPPD as α-ketoisocaproate dioxygenase be discontinued. The promiscuity of HPPD is also evident by its transformation of 2-keto-4-(methylthio)butyric acid, the keto acid of methionine [Adlington, R. M., et al., Bioorganic & Medicinal Chemistry Letters, Volume 6, Issue 16, 20 August 1996, 2003-2006].

There are several examples in the food, pharmaceutical, animal feed, biofuel, and biopolymer industries of producing ingredients through the use of metabolically engineered microorganisms and employing them in a fermentation process. Not all microorganisms are suited for the production of products. For example, bacteria are conventionally better suited for the production of amino acids, vitamins and enzymes while yeasts are better suited for the production of alcohols and organic acids. Therefore, selecting the appropriate microorganism to produce βHIV is critical. This disclosure relates to methods of selecting a microorganism for βHIV production.

Given that βHIV is produced using chemical processes that are not only energy-intensive, but also result in toxic by-products, there is a clear and urgent need to develop environmentally benign processes that use renewable feedstocks. There is also a need for the production of high quality βHIV that is cost-effective and efficiently produced.

SUMMARY

The subject of the present disclosure satisfies the need and provides related advantages as well. Provided herein are certain embodiments to create non-natural microorganisms to express or overexpress the βHIV metabolic pathway, methods of making these microorganisms, and using the microorganisms to produce βHIV.

Provided herein are methods to select and engineer microorganisms to produce beta hydroxyisovalerate (βHIV) and uses of the engineered, non-natural microorganisms. This disclosure also provides methods of producing βHIV by culturing the genetically modified microorganisms in the presence of at least one carbon source, then isolating βHIV from the culture. In certain embodiments, the carbon source is one or more of glucose, xylose, arabinose, sucrose and lactose.

In some embodiments, a non-natural microorganism comprises a metabolic pathway relating to one or more steps of (i) pyruvate to acetolactate, (ii) acetolactate to 2,3-dihydroxyisovalerate, (iii) 2,3-dihydroxyisovalerate to α-ketoisovalerate, (iv) α-ketoisovalerate to α-isopropylmalate, (v) α-isopropylmalate to β-isopropylmalate, (vi) β-isopropylmalate to α-ketoisocaproate and (vii) α-ketoisocaproate to βHIV. In some aspects, if the non-natural microorganism has different cellular compartments, one or more genes for the one or more steps (i) to (vii) for the metabolic pathway encodes an enzyme that is localized to the cytosol.

In some embodiments, a non-natural microorganism comprises a metabolic pathway relating to one or more steps of (i) pyruvate into acetolactate, (ii) acetolactate into 2,3-dihydroxyisovalerate, (iii) 2,3-dihydroxyisovalerate into α-ketoisovalerate, (iv) α-ketoisovalerate into 2-isopropylmalate, (v) 2-isopropylmalate into 2-isopropylmaleate, (vi) 2-isopropylmaleate into 3-isopropylmalate, (vii) 3-isopropylmalate into 2-isopropyl-3-oxosuccinate, (viii) 2-isopropyl-3-oxosuccinate into α-ketoisocaproate, and (ix) α-ketoisocaproate into βHIV. In some aspects, one or more genes for the one or more steps (i) to (ix) of the metabolic pathway encodes an enzyme that is localized to the cytosol.

In some embodiments, the non-natural microorganism expresses or overexpresses at least one of the genes encoding for acetolactate synthase, keto-acid reductoisomerase, dihydroxyacid dehydratase, 2-isopropylmalate synthase, isopropylmalate isomerase, 3-isopropylmalate dehydrogenase and βHIV synthase. In some aspects, the non-natural microorganism expresses or overexpresses two or more genes encoding for acetolactate synthase, keto-acid reductoisomerase, dihydroxyacid dehydratase, 2-isopropylmalate synthase, isopropylmalate isomerase, 3-isopropylmalate dehydrogenase and βHIV synthase.

In certain embodiments, the non-natural microorganisms having compartmentalized metabolism comprise a βHIV producing metabolic pathway with at least one βHIV pathway enzyme localized in the cytosol. In an exemplary embodiment, the non-natural microorganisms comprise a βHIV producing metabolic pathway with all the βHIV pathway enzymes localized in the cytosol.

In some embodiments, the non-natural eukaryotic microorganism expresses or overexpresses at least one of the genes encoding for cytosolic acetolactate synthase, cytosolic keto-acid reductoisomerase, cytosolic dihydroxyacid dehydratase, cytosolic 2-isopropylmalate synthase, cytosolic isopropylmalate isomerase, cytosolic 3-isopropylmalate dehydrogenase and cytosolic βHIV synthase. In some aspects, the non-natural eukaryotic microorganism expresses or overexpresses two or more genes encoding for cytosolic acetolactate synthase, cytosolic keto-acid reductoisomerase, cytosolic dihydroxyacid dehydratase, cytosolic 2-isopropylmalate synthase, cytosolic isopropylmalate isomerase, cytosolic 3-isopropylmalate dehydrogenase and cytosolic βHIV synthase.

In some embodiments, the non-natural microorganism comprises at least one nucleic acid encoding a polypeptide with beta hydroxyisovalerate synthase activity wherein said polypeptide is at least about 65% identical to at least one polypeptide selected from SEQ ID NOs: 1-3. In certain embodiments, the polypeptide with βHIV synthase activity is derived from *Rattus norvegicus.*

In certain embodiments, the non-natural microorganism comprises at least one nucleic acid encoding a polypeptide with βHIV synthase activity wherein said polypeptide is at least about 65% identical to at least one polypeptide selected from SEQ ID NOs: 4-5. In certain embodiments, the polypeptide with βHIV synthase activity is derived from *Yarrowia lipolytica.* In certain embodiments, the non-natural microorganism comprises at least one nucleic acid encoding a polypeptide with βHIV synthase activity wherein said polypeptide is at least about 65% identical to at least one polypeptide selected from SEQ ID NOs: 6-8. In certain embodiments, the polypeptide with βHIV synthase activity is derived from *Homo sapiens.*

In another embodiment, the non-natural microorganism comprises a dioxygenase enzyme which has been modified or mutated to increase the ability of the enzyme to preferentially utilize α-ketoisocaproate as its substrate. According to certain aspects of the present invention, the non-natural enzyme comprises one or more dioxygenase enzymes having one or more modifications or mutations at substrate-specificity positions corresponding to amino acids selected from A361, F336, F347, F364, F368, F371, G362, I227, I252, L224, L289, L323, L367, N187, N241, N363, P239, Q251, Q265, S226, V212, V217, V228 and W210 of SEQ ID NO: 1.

In some aspects, at least one of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 has been replaced with one of the corresponding disclosed amino acids to alter the respective substrate-specificity residue.

In some other aspects, two or more of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 have been replaced with one of the corresponding disclosed amino acids to alter the respective substrate-specificity residue.

In yet some other aspects, at least 3 and up to 24 of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 have been replaced with one of the corresponding disclosed amino acids to alter the respective substrate-specificity residue.

According to certain aspects of the present invention, the non-natural enzyme comprises one or more modifications at substrate-specificity positions corresponding to amino acids selected from A361, F336, F347, F364, F368, F371, G362, I227, I252, L224, L289, L323, L367, N187, N241, N363, P239, Q251, Q265, S226, V212, V217, V228 and W210 of SEQ ID NO: 6.

In some aspects, at least one of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 has been replaced with one of the corresponding disclosed amino acids to alter the respective substrate-specificity residue.

In some other aspects, two or more of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 have been replaced with one of the corresponding disclosed amino acids to alter the respective substrate-specificity residue.

In yet some other aspects, at least 3 and up to 24 of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 have been replaced with one of the corresponding disclosed amino acids to alter the respective substrate-specificity residue.

In certain embodiments, the non-natural microorganisms may be prokaryotic microorganisms. In another embodiment, the non-natural microorganism may be an eukaryotic microorganism. In certain embodiments, the non-natural eukaryotic microorganisms may be non-natural yeast microorganisms. In some embodiments, the non-natural yeast may be Crabtree-negative yeasts. In some embodiments, the non-natural yeast microorganism may be selected from the group consisting of *Saccharomyces, Kluyveromyces, Pichia, Issatchenkia, Hansenula,* or *Candida.*

In another embodiment, the non-natural microorganism may be cultivated in a culture medium containing a feedstock providing the carbon source until a recoverable quantity of βHIV is produced and optionally, recovering the βHIV. In certain embodiments, the non-natural microorganism produces βHIV from a carbon source with a yield of at least about 0.1 percent of theoretical yield. In another aspect, the non-natural microorganism produces βHIV from a carbon source with a yield of at least 1 percent of theoretical yield. In another aspect, the non-natural microorganism produces βHIV from a carbon source with a yield of at least about 5 percent of theoretical yield. In another aspect, the non-natural microorganism produces βHIV from a carbon source with a yield of at least 20 percent of theoretical yield. In another aspect, the non-natural microorganism produces βHIV from a carbon source with a yield of at least 50 percent, at least about 75 percent, at least about 80 percent, or at least about 85 percent of the theoretical yield.

In some aspects, the non-natural microorganism produces βHIV from a carbon source with a yield of at least about 0.1 percent up to 100 percent of theoretical yield, in some aspects at least about 1 percent up to 99.9 percent of theoretical yield, in some aspects at least about 5 percent up to about 99.5 of theoretical yield, in some aspects at least 20 percent up to about 99.5 percent of theoretical yield, in some aspects at least 50 percent up to about 99.5 percent of theoretical yield, in some aspects at least about 75 percent up to about 99.5 percent of theoretical yield, in some aspects at least about 80 percent up to about 99.5 percent of theoretical yield, and in some aspects at least about 85 percent up to about 99.5 percent of theoretical yield.

In some embodiments, the present invention is directed to a composition comprising βHIV produced by a non-natural microorganism, wherein the βHIV prior to any isolation or purification process has not been in substantial contact with any component comprising a halogen-containing component. In some aspects, the halogen-containing component is a chemical derivative produced by a typical chemical production process of βHIV. In some aspects, the halogen-containing component comprises hydrochloric acid and/or chloroform.

The above summary is not intended to describe each illustrated embodiment or every implementation of the subject matter hereof. The figures and the detailed description that follow more particularly exemplify various embodiments.

BRIEF DESCRIPTION OF THE FIGURES

Subject matter hereof may be more completely understood in consideration of the following detailed description of various embodiments in connection with the accompanying figures, in which.

Figure 1:
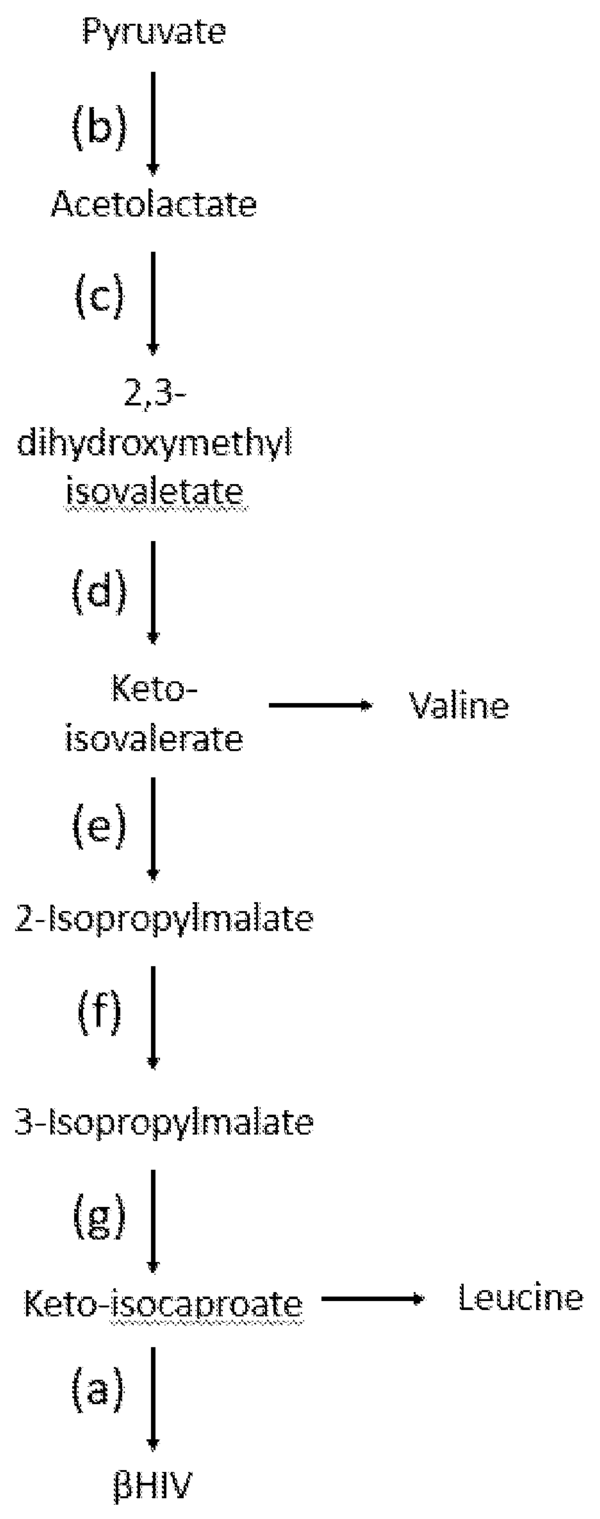
FIG. 1 illustrates a βHIV metabolic pathway, according to certain embodiments of the present invention. According to some aspects this disclosure, the metabolic pathway can also comprise an active transporter to transport βHIV out of the non-natural microorganism.

While various embodiments are amenable to various modifications and alternative forms, specifics thereof have been shown by way of example in the drawings and will be described in detail. It should be understood, however, that the intention is not to limit the claimed inventions to the particular embodiments described. On the contrary, the intention is to cover all modifications, equivalents, and alternatives falling within the spirit and scope of the subject matter as defined by the claims.

DETAILED DESCRIPTION OF THE INVENTION

The following description of the present disclosure is merely intended to illustrate various embodiments. As such, the specific modifications discussed are not to be construed as limitations on the scope of the present disclosure. It will be apparent to one skilled in the art that various equivalents, changes, and modifications may be made without departing from the scope of the present disclosure, and it is understood that such equivalent embodiments are to be included herein. All references cited herein are incorporated by reference in their entirety.

The present disclosure relates to non-natural microorganisms and the use of said microorganisms in a fermentation process to produce higher value products such as organic acids. More specifically, the present disclosure relates to engineered microorganisms that produce β-hydroxyisovaleric acid (βHIV). As a molecule with unique structure, βHIV has potential applications ranging from liquid crystals to pharmaceutical ingredients and dietary supplements.

As used herein, "β-hydroxyisovalerate" or "beta hydroxyisovalerate" or "βHIV" or "β-hydroxy-β-methylbutyrate" or "3-hydroxy-3-methylbutyric acid" refer to the same compound having the following molecular structures (free acid form on left and conjugate base on the right).

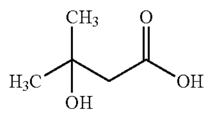

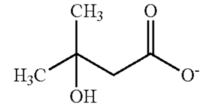

Furthermore, these terms not only include the free acid form or conjugate base, but also the salt form with a cation and derivatives thereof, or any combination of these compounds. For instance, a calcium salt of βHIV includes calcium βHIV hydrate having the following molecular structure.

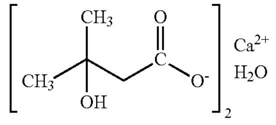

While the foregoing terms mean any form of βHIV, the form of βHIV used within the context of the present disclosure preferably is selected from the group comprising of a free acid, a calcium salt, an ester and a lactone.

As used herein, the term "microorganism" refers to a prokaryote such as a bacterium or a eukaryote such as a yeast or a fungus. As used herein, the term "non-natural microorganism" refers to a microorganism that has at least one genetic alteration not normally found in a naturally occurring strain of the species, including wild-type strains of the reference species. Genetic alterations include, for example, human-intervened modifications introducing expressible nucleic acids encoding polypeptides, other nucleic acid additions, nucleic acid deletions and/or other functional disruption of the microorganism's genetic material. When a microorganism is genetically engineered to overexpress a given enzyme, it is manipulated such that the host cell has the capability to express, and preferably, overexpress an enzyme, thereby increasing the biocatalytic capability of the cell. When a microorganism is engineered to inactivate a gene, it is manipulated such that the host cell has decreased, and preferably, lost the capability to express an enzyme. As used herein, the term "overexpress" refers to increasing the expression of an enzyme to a level greater than the cell normally produces. The term encompasses overexpression of endogenous as well as exogenous enzymes. As used herein, the terms "gene deletion" or "gene knockout" or "gene disruption" refer to the targeted disruption of the gene in vivo resulting in the removal of one or more nucleotides from the genome resulting in decreased or loss of function using genetic manipulation methods such as homologous recombination, directed mutagenesis or directed evolution.

As used herein, the term "gene" refers to a nucleic acid sequence that can be transcribed into messenger RNA and further translated into protein.

The term "nucleic acid" as used herein, includes reference to a deoxyribonucleotide or ribonucleotide polymer, i.e. a polynucleotide, in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids). A polynucleotide can be full-length or a subsequence of a native or heterologous structural or regulatory gene. Unless otherwise indicated, the term includes reference to the specified sequence as well as the complementary sequence thereof.

Usually, the nucleotide sequence encoding an enzyme is operably linked to a promoter that causes sufficient expression of the corresponding nucleotide sequence in the host microorganism according to the present disclosure to confer to the cell the ability to produce β-hydroxyisovaleric acid. As used herein, the term "operably linked" refers to a linkage of polynucleotide elements (or coding sequences or nucleic acid sequence) in a functional relationship. A nucleic acid sequence is "operably linked" when it is placed into a functional relationship with another nucleic acid sequence. For instance, a promoter or enhancer is operably linked to a coding sequence if it affects the transcription of the coding sequence. In order to increase the likelihood that an exogenous gene is translated into an enzyme that is in active form, the corresponding nucleotide sequence may be adapted to optimize its codon usage to that of the chosen host microorganism. Several methods for codon optimization are known in the art and are embedded in computer programs such as CodonW, GenSmart, CodonOpt, etc.

As used herein, the term "promoter" refers to a nucleic acid fragment that functions to control the transcription of one or more genes, located upstream with respect to the direction of transcription of the transcription initiation site of the gene, and is structurally identified by the presence of a binding site for a nucleic acid polymerase, transcription initiation sites and any other DNA sequences known to one of skill in the art. A "constitutive" promoter is a promoter that is active under most environmental and developmental conditions. An "inducible" promoter is a promoter that is active under environmental or developmental regulation.

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The essential nature of such analogues of naturally occurring amino acids is that, when incorporated into a protein, the protein is specifically reactive to antibodies elicited to the same protein but consisting entirely of naturally occurring amino acids. The terms "polypeptide", "peptide" and "protein" are also inclusive of modifications including, but not limited to, glycosylation, lipid attachment, sulfation, gamma-carboxylation of glutamic acid residues, hydroxylation and ADP-ribosylation.

The term "enzyme" as used herein is defined as a protein which catalyzes a (bio)chemical reaction in a cell. The interaction of an enzyme with other molecules such as the substrate can be quantified by the Michaelis constant ($K_M$), which indicates the affinity of the substrate to the active site of the enzyme. $K_M$ can be quantified using prior art (see for example, Stryer, Biochemistry, 4th edition, W. H. Freeman, Nelson and Cox, Lehninger Principles of Biochemistry, 6th edition, W. H. Freeman). The rate of biocatalysis or enzymatic activity is defined by $k_{cat}$, which is the enzyme turnover number. Therefore, the ratio of the rate of enzymatic activity to the substrate affinity is widely considered to be representative of an enzyme's catalytic efficiency. As defined herein, the efficiency of an enzyme to act on a specific substrate is quantified by the ratio of $k_{cat}/K_M$. Therefore, an enzyme with higher value of $k_{cat}/K_M$ for a certain substrate can catalyze the reaction more efficiently than another enzyme with a lower value of $k_{cat}/K_M$ for the same substrate. A non-natural enzyme refers to an enzyme that comprises at least one amino acid alteration at the desired position that is not normally found in nature. Amino acid alternations include, for example, human-intervened modifications introducing replacing one naturally occurring amino acid with another, addition or deletion of amino acids such that the modified enzyme has the capability of enhanced catalytic activity.

As used herein, β-hydroxyisovalerate synthase refers to an enzyme that can catalyze the conversion of α-ketoisocaproate into βHIV. One Unit (U) of βHIV synthase activity is defined here as the amount of enzyme needed to convert one micromole of α-ketoisocaproate into βHIV in one minute under the reaction conditions. Accordingly, a variant of βHIV synthase that can convert more α-ketoisocaproate into βHIV than the same amount of another variant is preferred.

The term "biosynthetic pathway", also referred to as "metabolic pathway", refers to a set of anabolic or catabolic biochemical reactions for converting one chemical species into another. Gene products belong to the same "metabolic pathway" if they, in parallel or in series, act on the same substrate, produce the same product, or act on or produce a metabolic intermediate (i.e., metabolite) between the same substrate and metabolite end product. As used herein, the term "βHIV metabolic pathway" or "βHIV pathway" refers to an enzyme pathway which produces βHIV from pyruvate, as illustrated in FIGS. 1 or FIG. 2.

The present disclosure relates to a non-natural microorganism for producing βHIV. Tolerance to high concentrations of βHIV is an important trait of a suitable microorganism. An ideal microorganism to enable βHIV production is capable of conducting fermentation at low pH levels to decrease downstream recovery costs, resulting in more economical production. Additional characteristics of a suitable microorganism include rapid growth and exhibit overall process robustness.

In some embodiments, the subject of the present disclosure relates to a non-natural microorganism having an active βHIV metabolic pathway from pyruvate to βHIV.

Figure 2:
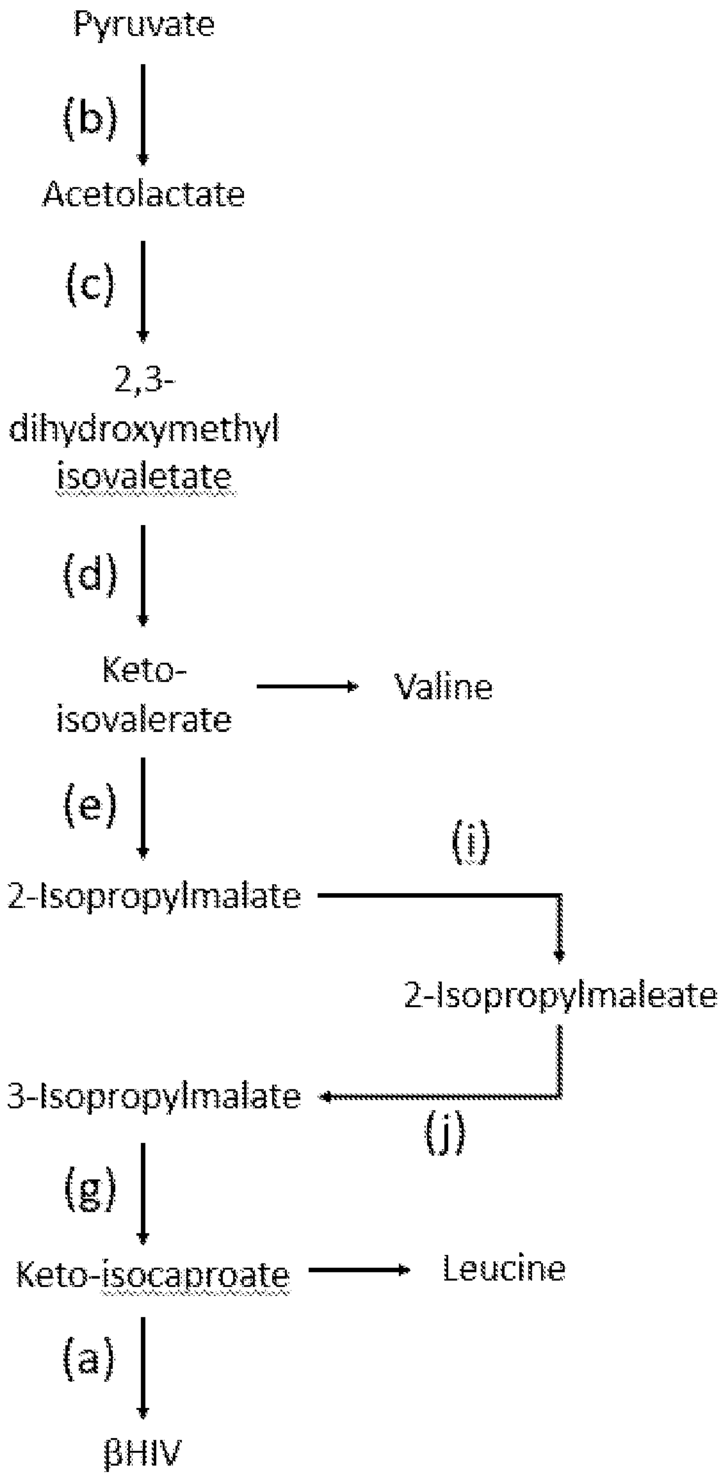
FIG. 2 illustrates another βHIV metabolic pathway, according to certain embodiments of the present invention. According to some aspects of this disclosure, the metabolic pathway can also comprise an active transporter to transport βHIV out of the non-natural microorganism.

A βHIV metabolic pathway is shown in FIG. 1. In some embodiments, βHIV metabolic pathway comprises of the conversion of pyruvate into 2-acetolactate, 2-acetolactate into 2,3-dihydroxy-isovalerate, 2,3-dihydroxy-isovalerate into α-ketoisovalerate, α-ketoisovalerate into 2-isopropylmalate, 2-isopropylmalate into 3-isopropylmalate, 3-isopropylmalate into KIC and KIC into βHIV.

Another βHIV metabolic pathway is shown in FIG. 2. In some embodiments, βHIV metabolic pathway comprises of the conversion of pyruvate into 2-acetolactate, 2-acetolactate into 2,3-dihydroxy-isovalerate, 2,3-dihydroxy-isovalerate into α-ketoisovalerate, α-ketoisovalerate into 2-isopropylmalate, 2-isopropylmalate into 2-isopropylmaleate, 2-isopropylmaleate into 3-isopropylmalate, 3-isopropylmalate into 2-isopropyl-3-oxosuccinate, 2-isopropyl-3-oxosuccinate into KIC, KIC into βHIV.

In some embodiments, the βHIV pathway also comprises a hydroxy acid transporter to facilitate the export of βHIV formed inside the microorganism to extracellular environment.

As used herein, the "theoretical yield" of βHIV refers to the molar ratio of βHIV that is produced extracellularly to the carbon source that is used. The theoretical yield can be calculated based on the biochemical conversion of glucose to pyruvate and the subsequent conversion of pyruvate into βHIV in the βHIV metabolic pathway, taking into consideration of the microorganism's native redox constraints to enable the conversion. For example, in yeast, the theoretical yield of βHIV from glucose is 0.667.

In a first example embodiment, the non-natural microorganism of the present disclosure (a) expresses or overexpresses at least one gene encoding for βHIV synthase, (b) expresses or overexpresses at least one gene encoding for acetolactate synthase, (c) expresses or overexpresses at least one gene encoding for acetohydroxy acid reductoisomerase, (d) expresses or overexpresses at least one gene encoding for 2,3-dihydroxy isovalerate dehydratase, (e) expresses or overexpresses at least one gene encoding for 2-isopropylmalate synthase (f) expresses or overexpresses at least one gene encoding for isopropylmalate isomerase, or (g) expresses or overexpresses at least one gene encoding for 3-isopropylmalate dehydrogenase. In some aspects, the non-natural microorganism of the present disclosure comprises a combination of two or more of (a), (b), (c) (d), (e), (f) and (g).

In a second example embodiment, the non-natural microorganism of the present disclosure (a) expresses or overexpresses at least one gene encoding for βHIV synthase, (b) expresses or overexpresses at least one gene encoding for acetolactate synthase, (c) expresses or overexpresses at least one gene encoding for 2,3-keto-acid reductoisomerase, (d) expresses or overexpresses at least one gene encoding for dihydroxy isovalerate dehydratase, (e) expresses or overexpresses at least one gene encoding for 2-isopropylmalate synthase, (i) expresses or overexpresses at least one gene encoding for 2-isopropylmalate hydrolyase (2-isopropylmaleate-forming), (j) expresses or overexpresses at least one gene encoding for 2-isopropylmalate hydrolyase (3-isopropylmalate-forming), (g) expresses or overexpresses at least one gene encoding for 3-isopropylmalate dehydrogenase. In some aspects, the non-natural organism of the present disclosure comprises a combination of two or more of (a), (b), (c) (d), (e), (i), (j) and (g).

In some embodiments, the non-natural microorganism of the present disclosure expresses or overexpresses at least one gene encoding a polypeptide with acetolactate synthase (EC: 2.2.1.6) activity. For example, acetolactate synthases capable of converting pyruvate to acetolactate may be derived from a variety of sources (e.g., bacterial, yeast, Archaea, etc.), including *B. subtilis* (GenBank Accession No. Q04789.3), *L. lactis* (GenBank Accession No. NP_267340.1), *S. mutans* (GenBank Accession No. NP_721805.1), *K. pneumoniae* (GenBank Accession No. PTD93137.1), *C. glutamicum* (GenBank Accession No. 1238373540), E, cloacae (GenBank Accession No. WP_013097652.1), *M. maripaiudis* (GenBank Accession No. ABX01060.1), P. grisea (GenBank Accession No. AAB81248.1), *T. stipitatus* (GenBank Accession No. XP_002485976.1), or *S. cerevisiae* ILV2 (GenBank Accession No. 1789111829). Additional acetolactate synthases capable of converting pyruvate to acetolactate are described in WO2013016724, which incorporated herein by reference in its entirety. A review article characterizing the biosynthesis of acetolactate from pyruvate via the activity of acetolactate synthases is provided by Chipman et al., 1998, Biochimica et Biophysica Acta 1385: 401-19. Chipman et al, provide an alignment and consensus for the sequences of a representative number of acetolactate synthases. Motifs shared in common between the majority of acetolactate synthases include: SGPG(A/C/V)(T/S)N, GX(P/A)GX (V7A/T), GX(Q/G)(T/A)(IJM)G(Y/F/W)(A/G)X(P/G)(W/A)AX(G/T)(A/V) and GD(G/A)(G/S/C)F, at amino acid positions corresponding to the 163-169, 240-245, 521-535, and 549-553 residues, respectively, of the *S. cerevisiae* ILV2. Thus, a protein harboring one or more of these amino acid motifs can generally be expected to exhibit acetolactate synthase activity. In some embodiments, the non-natural microorganism of the present disclosure expresses or overexpresses at least one gene encoding a polypeptide that is at least about 65% identical to at least one polypeptide selected from SEQ ID NOs: 297-300.

In some embodiments, the non-natural microorganism of the present disclosure expresses or overexpresses at least one gene encoding a polypeptide with acetohydroxy acid reductoisomerase activity (EC: 1.1.1.86). Acetohydroxy acid reductoisomerases capable of converting acetolactate to 2,3-dihydroxyisovaierate may be derived from a variety of sources (e.g., bacterial, yeast, Archaea, etc.), including *E. coli* (GenBank Accession No. EGB30597.1), *L. lactis* (GenBank Accession No. WP_012897822.1), *Shewanella* sp, (GenBank Accession No. WP_011621167.1), *A. fischeri* (GenBank Accession No. WP_005421503.1), *M. maripaludis* (GenBank Accession No. ABO35228.1), *B. subtilis* (GenBank Accession No. CAB14789), *S. pombe* (GenBank Accession No. NP_001018845) or *S. cerevisiae* ILV5 (GenBank Accession No. NP_013459.1). Additional ketol-acid reductoisomerases capable of converting acetolactate to 2,3-dihydroxyisovalerate are described in WO2013016724, incorporated herein by reference in its entirety. Motifs shared between a majority of acetohydroxy acid reductoisomerases include G(Y/C/W)GXQ(G/A), (F/Y/L)(S/A)HG (F/L), V(V/I/F)(M/L/A)(A/C)PK, D(L/I)XGE(Q/R) XXLXG and S(D/NAT)TA(E/Q/R)XG at amino acid positions corresponding to the 89-94, 175-179, 194-200, 282-272, and 459-465 residues, respectively, of the *E. coli* acetohydroxy acid reductoisomerase encoded by ilvC. Thus, a protein harboring one or more of these amino acid motifs can generally be expected to exhibit acetohydroxy acid reductoisomerase activity. The naturally existing acetohydroxy acid reductoisomerases preferentially use NADPH as a cofactor. Cofactor specificity can be switched to preferentially use NADH as a cofactor by means of modifying specific residues. Examples of such acetohydroxy acid reductoisomerases with increased preference for using NADH as a cofactor are described in US Publication No. 2010/0143997. In some embodiments, the non-natural microorganism of the present disclosure expresses or overexpresses at least one gene encoding a polypeptide that is at least about 65% identical to at least one polypeptide selected from SEQ ID NOs: 301-303.

In some embodiments, the non-natural microorganism of the present disclosure expresses or overexpresses at least one gene encoding a polypeptide with 2,3-dihydroxy isovalerate dehydratase activity (EC: 4.2.1.9). Dihydroxy acid dehydratases capable of converting 2,3-dihydroxyisovalerate to α-ketoisovalerate may be derived from a variety of sources (e.g., bacterial, yeast, Archaea, etc.), including *M. tuberculosis* (GenBank Accession No. CLR57443), *L. lactis* (GenBank Accession No. WP_010905837.1), *S. mutans* (GenBank Accession No. WP_002262431.1), *M. stadtmanae* (GenBank Accession No. WP_011407142.1), *M. tractuosa* (GenBank Accession No. WP_013453775.1), Eubacterium SCB49 (GenBank Accession No. WP_118518751.1), *Y. lipolytica* (GenBank Accession No. QNP96049.1), *N. crassa* (GenBank Accession No. XP_963045.1), or *S. cerevissae* ILV3 (GenBank Accession No. NP_012550.1). Additional dihydroxy acid dehydratases capable of 2,3-dihydroxyisovaierate to a-ketoisovalerate are described in WO02013016724, incorporated herein by reference in its entirety. Motifs shared in common between the majority of 2,3-dihydroxy isovalerate dehydratases include: SLXSRXXIA, CDKXXPG, GXCXGXXTAN, GGSTN, GPXGXPGMRXE, ALXTDGRXSG, and GHXXPEA motifs at amino acid positions corresponding to the 93-101, 122-128, 193-202, 276-280, 482-491, 509-518, and 526-532 residues, respectively, of the *E. coli* 2,3-dihydroxy isovalerate dehydratase. Thus, a protein harboring one or more of these amino acid motifs can generally be expected to exhibit 2,3-dihydroxy isovalerate dehydratase activity. In some embodiments, the non-natural microorganism of the present disclosure expresses or overexpresses at least one gene encoding a polypeptide that is at least about 65% identical to at least one polypeptide selected from SEQ ID NOs: 304-307.

In some embodiments, the non-natural microorganism of the present disclosure expresses or overexpresses at least one gene encoding a polypeptide with 2-isopropylmalate synthase activity (EC: 2.3.3.13). 2-isopropylmalate synthases capable of converting 3-methyl-2-oxobutanoate to (2S)-2-isopropylmalate may be derived from a variety of sources (e.g., bacterial, yeast, Archaea, etc.), including *C. glutamicum* (GenBank Accession No. WP_015439406), *E. coli* (GenBank Accession No. WP_000082850.1), *S. cerevisiae* (GenBank Accession No. NP_014295.1 (Leu4) and NP_014751.1 (Leu9), *M. maripaludis* (GenBank Accession No. WP_011171007.1) or *N. crassa* (GenBank Accession No. XP_964875.1). Motifs shared in common between the majority of the 2-isopropylmalate synthases include: LRDGXQ, IEVXFPXXSXXD, ISXHXHNDXGXXV, AGAXXVEG, GXGERXGNXXL at amino acid positions corresponding to the 12-17, 43-54, 199-211, 220-227, 231-241 residues, respectively, of the *E. coli* 2-isopropylmalate synthase. Thus, a protein harboring one or more of these amino acid motifs can generally be expected to exhibit 2-isopropylmalate synthase activity. In some embodiments, the non-natural microorganism of the present disclosure expresses or overexpresses at least one gene encoding a polypeptide that is at least about 65% identical to at least one polypeptide selected from SEQ ID NOs: 308-313.

In some embodiments, the non-natural microorganism of the present disclosure expresses or overexpresses at least one gene encoding a polypeptide with 2-isopropylmalate isomerase activity (EC: 4.2.1.33). In some embodiments, the isomerization of 2-isopropylmalate into 3-isopropylmalate is catalyzed by an enzyme that is expressed by one gene. Such 2-isopropylmalate isomerases capable of converting 2-isopropylmalate into 3-isopropylmalate may be derived from a variety of sources, including *S. cerevisiae* (GenBank Accession NP_011506.1), *P. kudriavzevii* (GenBank Accession No. XP_029320833.1) or *C. albicans* (GenBank Accession No. XP_718655.1). In some embodiments, the isomerization of 2-isopropylmalate into 3-isopropylmalate is catalyzed by an enzyme that is expressed by two genes, each gene encoding for a different subunit. Such 2-isopropylmalate isomerases capable of converting 2-isopropylmalate into 3-isopropylmalate may be derived from a variety of sources (e.g., bacterial, Archaea, etc.), including *M. tuberculosis* (GenBank Accession No. NP_217504.1), *L. lactis* (GenBank Accession No. WP_095586897.1), *S. mutans* (GenBank Accession No. WP_002262706.1), *C. glutamicum* (GenBank Accession No. WP_003858858.1), *M. maripaludis* (GenBank Accession No. WP_011171424.1) and *E. coli.* MG1655 (GenBank Accession No. NP_414614.1). In some embodiments, the non-natural microorganism of the present disclosure expresses or overexpresses at least one gene encoding a polypeptide with 2-isopropylmalate isomerase activity (EC: 4.2.1.33), containing a subunit with 3-isopropylmalate dehydratase activity. Motifs shared in common between the majority of the enzymes include: HEVTSPQAF, DSHTXTHGAFG, AFGIGT SEVEHVXATQT, CNMXIEXGA, VFXGSCTNXRXXDL, EXCASTSNRNFEGRQG, and GHXXPEA motifs at amino acid positions corresponding to the 33-41, 128-138, 141-157, 220-228, 342-355, and 422-437, residues, respectively, of the *E. coli* 3-isopropylmalate dehydratase. Thus, a protein harboring one or more of these amino acid motifs can generally be expected to exhibit 3-isopropylmalate dehydratase activity. In some embodiments, the non-natural microorganism of the present disclosure expresses or overexpresses at least one gene encoding a polypeptide that is at least about 65% identical to at least one polypeptide selected from SEQ ID NOs: 314-315.

In some embodiments, the non-natural microorganism of the present disclosure expresses or overexpresses at least one gene encoding a polypeptide with 3-isopropylmalate dehydrogenase activity (EC: 1.1.1.85). 3-isopropylmalate dehydrogenase capable of converting (2R,3S)-3-isopropylmalate to 4-Methyl-2-oxopentanoate may be derived from a variety of sources (e.g., bacterial, yeast, Archaea, plant, etc.), including *A. thahana* (GenBank Accession No. NP_001322636.1), *L. lactis* (GenBank Accession No. WP_095586896.1), *S. mutans* (GenBank Accession No. WP_002262707.1), *C. glutamicum* (GenBank Accession No. WP_011014258.1), *M. maripaludis* (GenBank Accession No. WP_011170483.1), *E. coli.* MG1655 (GenBank Accession No. NP_414615.4), *P. kudriavzevii* (GenBank Accession No. XP_029322355.1), *C. albicans* (GenBank Accession No. XP_720371.1), or *S. cerevisiae* S288C (GenBank Accession No. NP_009911.2). Motifs shared in common between the majority of 3-isopropylmalate hydratases include: DAXLLGAXGXP, VRELXGGIYFG, DKXNVL, TXNXFGDILSDEA, LXEPXHGSAPD, and NPXAXILSXAMXL motifs at amino acid positions corresponding to the 69-79, 137-147, 260-265, 245-257, 279-289, and 297-309 residues, respectively, of the *E. coli* 3-isopropylmalate dehydrogenase. Thus, a protein harboring one or more of these amino acid motifs can generally be expected to exhibit 3-isopropylmalate dehydrogenase activity. In some embodiments, the non-natural microorganism of the present disclosure expresses or overexpresses at least one gene encoding a polypeptide that is at least about 65% identical to at least one polypeptide selected from SEQ ID NOs: 316-320.

In some embodiments, the non-natural microorganism of the present disclosure expresses or overexpresses at least one gene encoding a polypeptide with βHIV synthase activity. The non-natural enzymes disclosed herein have low activity using 4-hydroxyphenylpyruvate, thereby not introducing any undesirable alterations in the metabolism. The present disclosure describes methods of increasing βHIV production through the use of non-natural microorganisms. Accordingly, the present disclosure is directed to an isolated nucleic acid encoding a polypeptide with βHIV synthase activity, wherein the polypeptide sequence is at least 65% identical to at least one polypeptide selected from any of SEQ ID Nos: 1-148. Methods to determine identity and similarity are codified in publicly available computer programs. Example computer program methods to determine identity and similarity between two sequences include BLASTP and BLASTN, publicly available from NCBI and other sources (BLAST Manual, Altschul, S., et al., NCBI NLM NIH Bethesda, Md. 20894). Example parameters for amino acid sequences comparison using BLASTP are gap open 11.0, gap extend 1, Blosum 62 matrix.

In certain embodiments, the polypeptide with βHIV synthase activity is derived from the genus *Rattus.* In an example embodiment, the polypeptide with βHIV synthase activity is derived from *Rattus norvegicus,* F alloantigen *Rattus norvegicus, Rattus* or *Rattus losea.* In another example embodiment, the polypeptide with βHIV synthase activity is selected from at least one of SEQ ID NOS: 1-3.

In some embodiments, the polypeptide with βHIV synthase activity has at least 65% identity to at least one polypeptide selected from any of SEQ ID NOS: 1-148. Further within the scope of the present application are polypeptides with βHIV synthase activity which are at least about 65%, 70%, 75%, 80%, 85%, 90%, 91%, 92%, 93%, 94%, 95%, 98%, 97%, 98%, 99%, or 99.5% identical to at least one polypeptide selected from any of SEQ ID NOS: 1-148. In some embodiments, the non-natural microorganism expresses or overexpresses a nucleic acid encoding at least one polypeptide with βHIV synthase activity selected from any of SEQ ID NOS: 149-288.

The promiscuous activity of HPPD with KIC is indicative of a basal level recognition of the desired substrate and the present disclosure discloses methods to increase KIC/HPP activity by modifying certain amino acids at specific positions in the sequence. Modifying amino acids that play a role in the catalysis can lead to alterations in the enzyme activity. One skilled in the art can recognize the position of these amino acids in homologous protein sequences by aligning the sequences. Two sequences are said to be "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art. The BLOSUM82 matrix is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al, (1997) Nucleic Acids Res. 25:3389-3402, and made available to the public at the National Center for Biotechnology Information Website. Optimal alignments, including multiple alignments, can be prepared using, e.g., PSI-BLAST with no compositional adjustments.

As described herein, the present inventors identified polypeptides with βHIV synthase activity. One desirable feature of a polypeptide with βHIV synthase activity is the ability to exhibit high activity for the conversion of KIC into βHIV in the βHIV metabolic pathway. Another desirable property of a polypeptide with βHIV synthase activity is the low activity with HPP, thereby reducing the impact on other aspects of metabolism. The present disclosure identifies several beneficial modifications or mutations which can be made to an existing dioxygenase enzyme to improve the dioxygenase enzyme's ability to catalyze the conversion of KIC to βHIV with higher activity. In some embodiments, the non-natural microorganism expresses or overexpresses at least one gene encoding a polypeptide with increased KIC/HPP activity, wherein the sequence of the polypeptide has at least one modification.

According to certain aspects of the present invention, the non-natural enzyme comprises one or more modifications at substrate-specificity positions corresponding to amino acids selected from A361, F336, F347, F364, F368, F371, G362, I227, I252, L224, L289, L323, L367, N187, N241, N363, P239, Q251, Q265, 5226, V212, V217, V228 and W210 of SEQ ID NO: 1.

According to certain aspects of the present invention, the non-natural enzyme comprises one or more modifications at substrate-specificity positions corresponding to amino acids selected from A361, F336, F347, F364, F368, F371, G362, I227, I252, L224, L289, L323, L367, N187, N241, N363, P239, Q251, Q265, 5226, V212, V217, V228 and W210 of SEQ ID NO: 6.

In some embodiments, the dioxygenase enzyme has been modified or mutated to alter one or more substrate-specificity residues. In certain embodiments, the dioxygenase enzyme is modified, wherein the residue corresponding to position 361 of SEQ ID NO: 1 is replaced with a residue selected from methionine, leucine and isoleucine. In another embodiment, the dioxygenase enzyme is modified, wherein the residue corresponding to position 336 of SEQ ID NO: 1 is replaced with leucine, methionine, isoleucine and tryptophan. In another embodiment, the dioxygenase enzyme is modified, wherein the residue corresponding to position 347 of SEQ ID NO: 1 is replaced with tryptophan, tyrosine and isoleucine. In another embodiment, the dioxygenase enzyme is modified, wherein the residue corresponding to position 364 of SEQ ID NO: 1 is replaced with methionine, alanine, isoleucine, leucine and tryptophan. In another embodiment, the dioxygenase enzyme is modified, wherein the residue corresponding to position 368 of SEQ ID NO: 1 is replaced with tyrosine, tryptophan, leucine, isoleucine and methionine. In another embodiment, the dioxygenase enzyme is modified, wherein the residue corresponding to position 371 of SEQ ID NO: 1 is replaced with methionine, leucine and isoleucine. In another embodiment, the dioxygenase enzyme is modified, wherein the residue corresponding to position 362 of SEQ ID NO: 1 is replaced with methionine, leucine and isoleucine. In another embodiment, the dioxygenase enzyme is modified, wherein the residue corresponding to position 227 of SEQ ID NO: 1 is replaced with methionine, leucine and isoleucine. In another embodiment, the dioxygenase enzyme is modified, wherein the residue corresponding to position 252 of SEQ ID NO: 1 is replaced with methionine, leucine and valine. In another embodiment, the dioxygenase enzyme is modified, wherein the residue corresponding to position 361 of SEQ ID NO: 1 is replaced with threonine. In another embodiment, the dioxygenase enzyme is modified, wherein the residue corresponding to position 224 of SEQ ID NO: 1 is replaced with methionine, phenylalanine and tryptophan. In another embodiment, the dioxygenase enzyme is modified, wherein the residue corresponding to position 289 of SEQ ID NO: 1 is replaced with methionine, leucine and isoleucine. In another embodiment, the dioxygenase enzyme is modified, wherein the residue corresponding to position 323 of SEQ ID NO: 1 is replaced with tryptophan, tyrosine and isoleucine. In another embodiment, the dioxygenase enzyme is modified, wherein the residue corresponding to position 367 of SEQ ID NO: 1 is replaced with methionine, leucine, isoleucine and tryptophan. In another embodiment, the dioxygenase enzyme is modified, wherein the residue corresponding to position 187 of SEQ ID NO: 1 is replaced with methionine, phenylalanine and tryptophan. In another embodiment, the dioxygenase enzyme is modified, wherein the residue corresponding to position 241 of SEQ ID NO: 1 is replaced with methionine, phenylalanine and tryptophan. In another embodiment, the dioxygenase enzyme is modified, wherein the residue corresponding to position 363 of SEQ ID NO: 1 is replaced with methionine, isoleucine and valine. In another embodiment, the dioxygenase enzyme is modified, wherein the residue corresponding to position 239 of SEQ ID NO: 1 is replaced with leucine. In another embodiment, the dioxygenase enzyme is modified, wherein the residue corresponding to position 251 of SEQ ID NO: 1 is replaced with methionine, isoleucine and proline. In another embodiment, the dioxygenase enzyme is modified, wherein the residue corresponding to position 265 of SEQ ID NO: 1 is replaced with methionine, isoleucine and proline. In another embodiment, the dioxygenase enzyme is modified, wherein the residue corresponding to position 226 of SEQ ID NO: 1 is replaced with methionine, valine, isoleucine and leucine. In another embodiment, the dioxygenase enzyme is modified, wherein the residue corresponding to position 212 of SEQ ID NO: 1 is replaced with phenylalanine, leucine, isoleucine or tryptophan. In another embodiment, the dioxygenase enzyme is modified, wherein the residue corresponding to position 217 of SEQ ID NO: 1 is replaced with methionine, isoleucine or leucine. In another embodiment, the dioxygenase enzyme is modified, wherein the residue corresponding to position 228 of SEQ ID NO: 1 is replaced with methionine, isoleucine or leucine. In another embodiment, the dioxygenase enzyme is modified, wherein the residue corresponding to position 210 of SEQ ID NO: 1 is replaced with leucine.

In some aspects, at least one of the substrate-specificity positions corresponding to amino acids selected from the group consisting of A361, F336, F347, F364, F368, F371, G362, I227, I252, L224, L289, L323, L367, N187, N241, N363, P239, Q251, Q265, 5226, V212, V217, V228 and W210 of SEQ ID NO: 1 has been replaced with one of the corresponding disclosed amino acids to alter the respective substrate-specificity residue.

In some other aspects, two or more of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 have been replaced with one of the corresponding disclosed amino acids to alter the respective substrate-specificity residue.

In yet some other aspects, at least 3 and up to 24 of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 have been replaced with one of the corresponding disclosed amino acids to alter the respective substrate-specificity residue.

In some embodiments, the dioxygenase enzyme has been modified or mutated to alter one or more one of the substrate-specificity residues. In certain embodiments, the dioxygenase enzyme is modified, wherein the residue corresponding to position 361 of SEQ ID NO: 6 is replaced with a residue selected from methionine, leucine and isoleucine. In another embodiment, the dioxygenase enzyme is modified, wherein the residue corresponding to position 336 of SEQ ID NO: 6 is replaced with leucine, methionine, isoleucine and tryptophan. In another embodiment, the dioxygenase enzyme is modified, wherein the residue corresponding to position 347 of SEQ ID NO: 6 is replaced with tryptophan, tyrosine and isoleucine. In another embodiment, the dioxygenase enzyme is modified, wherein the residue corresponding to position 364 of SEQ ID NO: 6 is replaced with methionine, alanine, isoleucine, leucine and tryptophan. In another embodiment, the dioxygenase enzyme is modified, wherein the residue corresponding to position 368 of SEQ ID NO: 6 is replaced with tyrosine, tryptophan, leucine, isoleucine and methionine. In another embodiment, the dioxygenase enzyme is modified, wherein the residue corresponding to position 371 of SEQ ID NO: 6 is replaced with methionine, leucine and isoleucine. In another embodiment, the dioxygenase enzyme is modified, wherein the residue corresponding to position 362 of SEQ ID NO: 6 is replaced with methionine, leucine and isoleucine. In another embodiment, the dioxygenase enzyme is modified, wherein the residue corresponding to position 227 of SEQ ID NO: 6 is replaced with methionine, leucine and isoleucine. In another embodiment, the dioxygenase enzyme is modified, wherein the residue corresponding to position 252 of SEQ ID NO: 6 is replaced with methionine, leucine and valine. In another embodiment, the dioxygenase enzyme is modified, wherein the residue corresponding to position 361 of SEQ ID NO: 6 is replaced with threonine. In another embodiment, the dioxygenase enzyme is modified, wherein the residue corresponding to position 224 of SEQ ID NO: 6 is replaced with methionine, phenylalanine and tryptophan. In another embodiment, the dioxygenase enzyme is modified, wherein the residue corresponding to position 289 of SEQ ID NO: 6 is replaced with methionine, leucine and isoleucine. In another embodiment, the dioxygenase enzyme is modified, wherein the residue corresponding to position 323 of SEQ ID NO: 6 is replaced with tryptophan, tyrosine and isoleucine. In another embodiment, the dioxygenase enzyme is modified, wherein the residue corresponding to position 367 of SEQ ID NO: 6 is replaced with methionine, leucine, isoleucine and tryptophan. In another embodiment, the dioxygenase enzyme is modified, wherein the residue corresponding to position 187 of SEQ ID NO: 6 is replaced with methionine, phenylalanine and tryptophan. In another embodiment, the dioxygenase enzyme is modified, wherein the residue corresponding to position 241 of SEQ ID NO: 6 is replaced with methionine, phenylalanine and tryptophan. In another embodiment, the dioxygenase enzyme is modified, wherein the residue corresponding to position 363 of SEQ ID NO: 6 is replaced with methionine, isoleucine and valine. In another embodiment, the dioxygenase enzyme is modified, wherein the residue corresponding to position 239 of SEQ ID NO: 6 is replaced with leucine. In another embodiment, the dioxygenase enzyme is modified, wherein the residue corresponding to position 251 of SEQ ID NO: 6 is replaced with methionine, isoleucine and proline. In another embodiment, the dioxygenase enzyme is modified, wherein the residue corresponding to position 265 of SEQ ID NO: 6 is replaced with methionine, isoleucine and proline. In another embodiment, the dioxygenase enzyme is modified, wherein the residue corresponding to position 226 of SEQ ID NO: 6 is replaced with methionine, valine, isoleucine and leucine. In another embodiment, the dioxygenase enzyme is modified, wherein the residue corresponding to position 212 of SEQ ID NO: 6 is replaced with phenylalanine, leucine, isoleucine or tryptophan. In another embodiment, the dioxygenase enzyme is modified, wherein the residue corresponding to position 217 of SEQ ID NO: 6 is replaced with methionine, isoleucine or leucine. In another embodiment, the dioxygenase enzyme is modified, wherein the residue corresponding to position 228 of SEQ ID NO: 6 is replaced with methionine, isoleucine or leucine. In another embodiment, the dioxygenase enzyme is modified, wherein the residue corresponding to position 210 of SEQ ID NO: 6 is replaced with leucine.

In some aspects, at least one of the substrate-specificity positions corresponding to amino acids selected from the group consisting of A361, F336, F347, F364, F368, F371, G362, I227, I252, L224, L289, L323, L367, N187, N241, N363, P239, Q251, Q265, 5226, V212, V217, V228 and W210 of SEQ ID NO: 6 has been replaced with one of the corresponding disclosed amino acids to alter the respective substrate-specificity residue.

In some other aspects, two or more of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 have been replaced with one of the corresponding disclosed amino acids to alter the respective substrate-specificity residue.

In yet some other aspects, at least 3 and up to 24 of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 have been replaced with one of the corresponding disclosed amino acids to alter the respective substrate-specificity residue.

In an exemplary embodiment, the modified dioxygenase enzyme is derived from a corresponding unmodified dioxygenase that is at least about 65%, 70%, 75%, 80%, 85%, 90%, 91%, 92%, 93%, 94%, 95%, 96%, 97%, 98%, 99%, or 99.5% identical to a polypeptide selected from SEQ ID NOS: 1-8.

In some embodiments, the present disclosure relates to a polypeptide with increased βHIV synthase activity, wherein the polypeptide sequence is derived from *Yarrowia lipolytica* and is at least 65% identical to a polypeptide selected from either of SEQ ID NOs: 4-5 and has been modified or mutated to alter one or more one the substrate-specificity residues. In certain embodiments, the polypeptide is modified at one or more positions corresponding to amino acids selected from A374, F349, F360, F377, F381, I384, G375, V240, I265, A374, L237, I302, L336, L380, N200, N254, N377, P252, Q264, Q278, 5239, V225, 1230, V241 and W223. In an exemplary embodiment, the modified decarboxylase enzyme is derived from a corresponding unmodified decarboxylase that is at least about 65%, 70%, 75%, 80%, 85%, 90%, 91%, 92%, 93%, 94%, 95%, 96%, 97%, 98%, 99%, or 99.5% identical to a polypeptide selected from either of SEQ ID NOs: 4-5.

Corresponding amino acids in other decarboxylases are easily identified by visual inspection of the amino acid sequences or by using commercially available homology software programs. Thus, given the defined regions for changes and the assays described in the present application, one with skill in the art can make one or a number of modifications which would result in an increased ability to specifically catalyze the conversion of KIC to βHIV, in any homologous dioxygenase enzyme of interest. The modified polypeptides can be optimally aligned with the corresponding unmodified, wild-type dioxygenase enzymes to generate a similarity score which is at least about 50%, more preferably at least about 60%, more preferably at least about 70%, more preferably at least about 80%, more preferably at least about 90%, or most preferably at least about 95% of the score for the reference sequence using the BLOSUM82 matrix, with a gap existence penalty of 11 and a gap extension penalty of 1.

In some embodiments, the non-natural microorganism expresses or overexpresses a nucleic acid encoding fragments of the disclosed polypeptides which comprises at least 25, 30, 40, 50, 100, 150, 200, 250, 300 or 375 amino acids and retain βHIV synthase activity. Such fragments may be obtained by deletion mutation, by recombinant techniques that are routine and well-known in the art, or by enzymatic digestion of the polypeptides of interest using any of a number of well-known proteolytic enzymes.

In some embodiments, the non-natural microorganism comprises at least one nucleic acid molecule encoding a polypeptide with βHIV synthase activity, wherein said polypeptide is at least about 65% identical to a polypeptide selected from SEQ ID NOS: 1-148 Further within the scope of present disclosure are recombinant microorganisms comprising at least one nucleic acid molecule encoding a polypeptide with βHIV synthase activity, wherein said polypeptide is at least about 70%, 75%, 80%, 85%, 90%, 91%, 92%, 93%, 94%, 95%, 96%, 97%, 98%, 99%, or 99.5% identical to a polypeptide selected from SEQ ID NOS: 1-149.

In accordance with the present disclosure, any number of mutations can be made to the βHIV synthase enzymes, and in certain embodiments, multiple mutations can be made to result in an increased ability to catalyze the conversion of KIC to βHIV with high catalytic efficiency. Such mutations can include point mutations, frame shift mutations, deletions, and insertions. In certain embodiments, one or more (e.g., one, two, three, four, five, six, seven, eight, nine, ten or more, etc.) point mutations may be preferred.

In some embodiments, the βHIV synthase will have an intact C-terminus. As defined herein, the C-terminus of HPPD is the stretch of residues that include the C-terminal α-helix that shields the active site. For example, in SEQ ID NO: 1, the stretch of amino acids from 361 to 393 are considered the C-terminus. In some embodiments, the residues comprising the C-terminus are modified to allow increased activity with KIC. In some embodiments, the C-terminus of the HPPD is in a conformation to have the highest specificity for KIC.

In one embodiment, the βHIV metabolic pathway is localized to the cytosol of the non-natural microorganism. In one embodiment, the non-natural microorganism comprises a βHIV metabolic pathway with at least one pathway enzyme localized in the cytosol.

In some embodiments, the non-natural microorganism belongs to a genus selected from the group consisting of *Escherichia, Corynebacterium, Lactobacillus, Lactococcus* and *Bacillus.* In some embodiments, the non-natural microorganism belongs to a genus selected from the group consisting of *Saccharomyces, Kluyveromyces, Issatchenkia, Galactomyces, Pichia* and *Candida.*

In some embodiments where the non-natural microorganism is a eukaryote, the βHIV metabolic pathway is expressed or overexpressed in its cytosol.

In certain embodiments, the non-natural microorganism comes in contact with a carbon source in a fermenter to produce βHIV and introducing into the fermenter sufficient nutrients where the final concentration of β-hydroxyisovalerate concentration in the fermentation broth is greater than about 10 mg/L (for example, greater than about 100 mg/L, for example, greater than about 1 g/L, greater than about 5 g/L, greater than about 10 g/L, greater than about 20 g/L, greater than about 40 g/L, greater than 50 g/L), but usually below 150 g/L. In certain embodiments, the carbon source is selected from the group consisting of glucose, xylose, arabinose, sucrose, fructose, lactose, glycerol, and mixtures thereof.

In some embodiments, βHIV thus produced is optionally recovered from the fermentation broth by first removing the cells, followed by separating the aqueous phase from the clarified fermentation broth along with the other by-products of the fermentation. In some embodiments, the βHIV is co-purified with other fermentation-derived products, wherein the composition comprises at least one fermentation-derived impurity. In some embodiments, fermentation-derived products are selected from the group consisting of organic acids and amino acids. In some embodiments, βHIV synthesized according to the present disclosure is substantially devoid of chloroform or hydrochloric acid.

The object of the present disclosure is further illustrated by the following examples that should not be construed as limiting. Examples are provided for clarity of understanding. While the object of the present disclosure has been described in connection with embodiments thereof, it will be understood that it is capable of further modifications and this disclosure is intended to cover variations, user or adaptations of the present disclosure following, in general, the principles of the present disclosure and including such departures from the present disclosure as come within known or customary practice within the art to which the present disclosure pertains and as may be applied to the essential features hereinbefore set forth and as follows in the scope of the appended claims. The contents of all references, patents, and published patent applications cited throughout this application, as well as the Figures and the Sequence Listings, are incorporated herein by reference for all purposes.

EXAMPLES

Example 1: Selection of Microorganisms

This example illustrates a method to select microorganisms that are a priori suited to produce βHIV. Several bacteria and yeasts were tested for their ability to grow in the presence of βHIV. Bacterial strains—*Corynebacterium glutamicum* NRRL B-2784, *Escherichia coli* MG1655 and yeast strains—*Saccharomyces cerevisiae* CENPK.2, *Kluyveromyces marxianus* NRRL Y-318, NRRL Y-6373, *Pichia kudriavzevii* NRRL Y-7551, NRRL Y-5396 were selected as exemplary microorganism to evaluate their ability to grow in the presence of βHIV. Growth is considered an indicator of overall metabolic activity. The bacterial strains were started in LB medium and the yeast strains were started in YPD medium at conditions that are reportedly ideal for optimal growth. For example, *E. coli* strain was started from cryo-vials in LB medium at 37° C. and *S. cerevisiae* was started from cryo-vials in YPD medium at 30° C.

Figure 3:
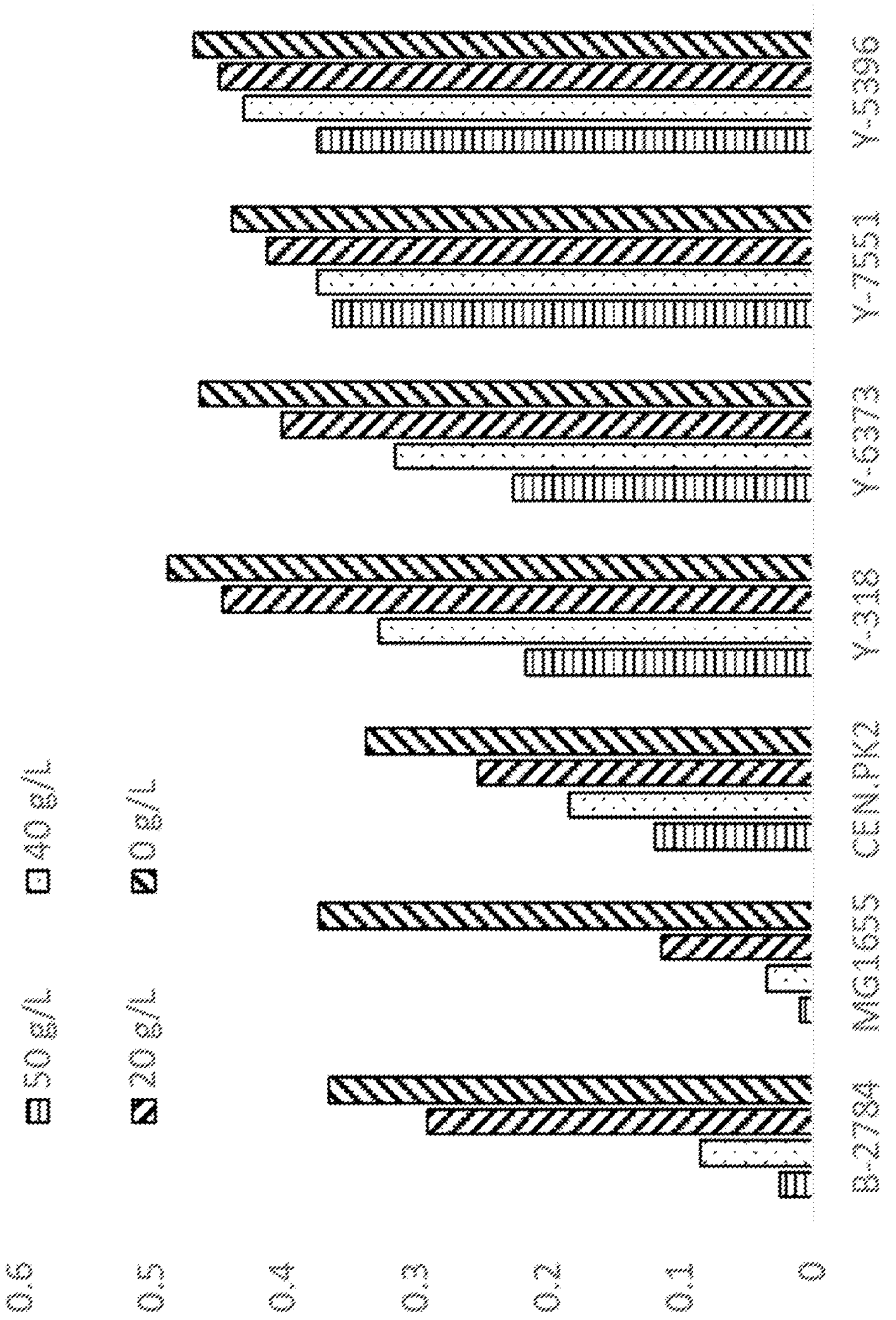
FIG. 3 illustrates the growth of microorganisms as maximum specific growth rate in the presence of various concentrations of βHIV in the media as an indicator of metabolic activity.

Seed cultures of all the strains were transferred into minimal mineral salts medium, supplemented with 2% glucose. To the same media βHIV was added to a final concentration of 20 g/L, 40 g/L or 50 g/L. Growth of the microorganisms in the presence of βHIV was monitored in BioLector II (m2p Labs, Aachen, Germany) in triplicate. The maximum specific growth rate of these microorganisms in the presence of various concentrations of βHIV was calculated and shown in FIG. 3. Typically yeasts grew faster than bacteria at higher concentrations of βHIV, suggesting faster glucose uptake. Specifically, Y-6373, Y-7551 and Y-5396 exhibited the fastest growth and are potential candidates to host the βHIV metabolic pathway. This example illustrates a method to screen and select appropriate host microorganisms for producing βHIV.

Example 2: Production of βHIV in Bacteria

Figure 4:
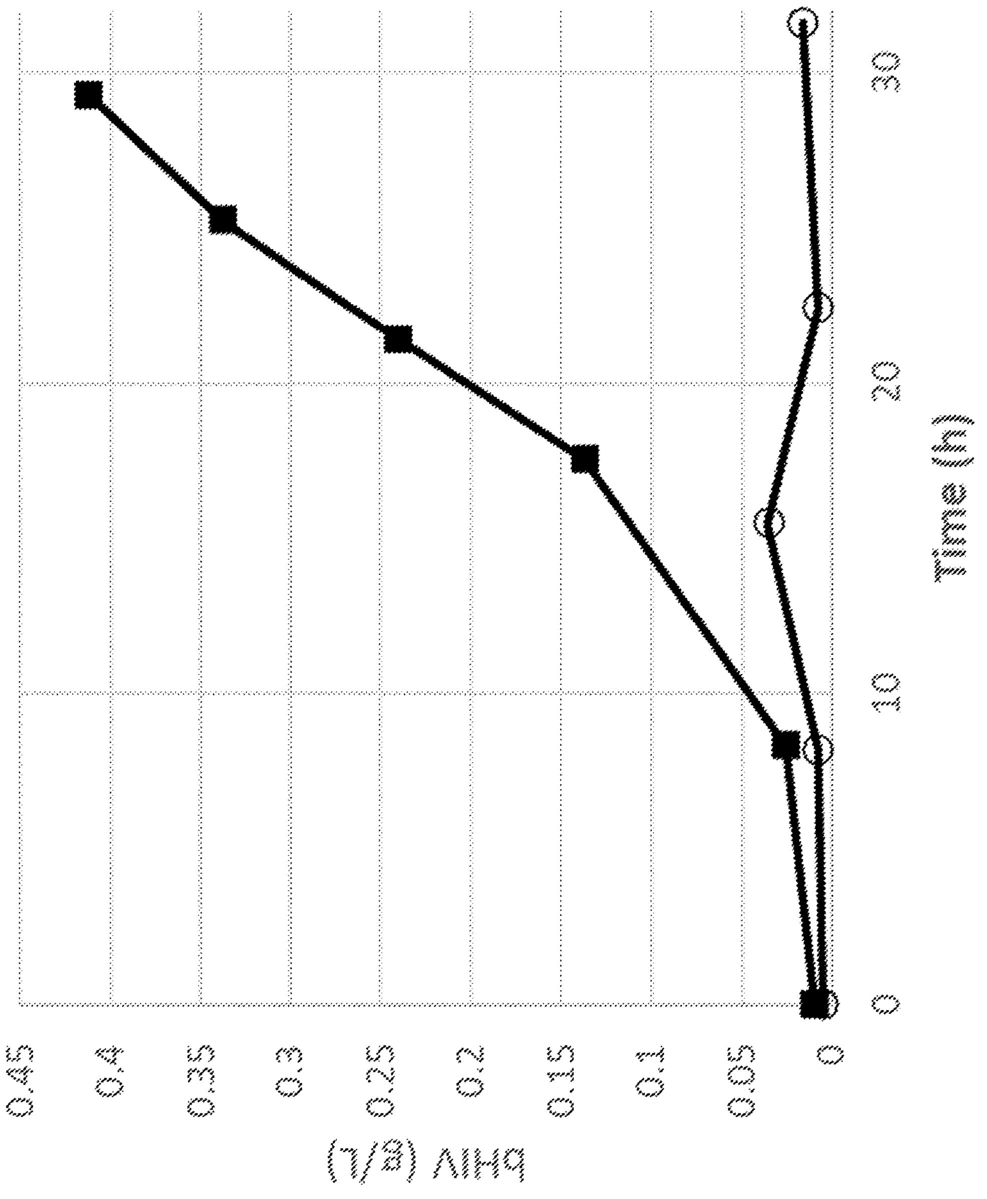
FIG. 4 illustrates the production of βHIV using non-natural bacteria.

This example illustrates the production of βHIV in bacteria and yeast. A strain of *Corynebacterium glutamicum* MV-KICF1 (Applied Microbiol, Microb Biotech ,8, 351-360) that was metabolically modified to produce α-ketoisocaproate was used to introduce a gene that encodes for a polypeptide encoding SEQ ID NO: 1. The codons in the nucleic acid sequence of the gene were optimized according to the codon usage of the bacterium and the DNA was cloned into pZ8-ptac vector (Cleto et al., ACS Synth Biol. 2016 May 20; 5(5): 375-385) and transformed into MV-KICF1 by electroporation. The non-natural bacterial strain endowed with the capability to produce βHIV was propagated in Brain-Heart Infusion medium and cultivated in CGXII medium (Hoffman et al., J Appl Microbiol., 2014, 117: 663-678) using glucose as the main carbon source to evaluate the βHIV production. Substrate consumption and product formation was evaluated on Agilent 1200 HPLC using 5mM H2SO4 as the mobile phase with Aminex HPX-87c column (BioRad, Hercules, CA). As illustrated in FIG. 4, the non-natural bacterium comprising βHIV synthase produced more βHIV than its parent wild-type.

Example 3: Assembling βHIV Metabolic Pathway in Yeast Cytosol

This example provides methods to assemble βHIV metabolic pathway shown in FIG. 1 in Y-5396 yeast. The example also provides methods for discriminating between enzymes (genes) that perform the same function. All DNA modifications were performed based on a reference genome that is available publicly (Douglass et al., 2018, PLoS Pathog, 14(7):e1007138). To facilitate use of URA3 as a selection marker, both alleles of URA3 in the diploid yeast Y-5396 were deleted. The first URA3 allele was replaced by a KanMX cassette conferring Geneticin resistance and flanked by loxP sites by transforming a KanMX cassette flanked by ~500 bases of homology upstream and downstream of URA3 into Y-5396. Transformants were selected on media containing Geneticin and insertion of the cassette in the URA3 locus confirmed by PCR, creating strain SB500. To delete the second URA3 allele ~500 bases upstream and ~500 bases downstream of URA3 were joined via overlap extension PCR to create a clean deletion construct and transformed into SB500. Transformants were plated on 5-fluorootic acid to select for mutants that had lost both alleles of URA3. The clean deletion of the second allele was confirmed by PCR and the KanMX cassette insertion was re-confirmed, to create strain SB501. Finally, the KanMX cassette was removed by transient expression of Cre recombinase from an unstable plasmid that conferred resistance to Hygromycin. Colonies were then screened for loss of Geneticin resistance (loss of KanMX), loss of Hygromycin resistance (plasmid marker), and ability to grow on 5-FOA (double deletion of URA3). Genomic DNA at the URA3 locus was PCR-amplified and sequenced to confirm the deletions had occurred as expected. The resulting strain called SB502, which has the two copies of the URA3 gene deleted to facilitate the use of uracil for selection.

Genes encoding for enzymes in the βHIV metabolic pathway were inserted in the chromosome at intergenic loci using homologous recombination. Chromosomal integration of heterologous genes to assemble the βHIV metabolic pathway is illustrated for α-isopropylmalate synthase (IPMS) as an example. One plasmid (p1) was constructed containing the integration site 5' homology arm, IPMS expression cassette, and the 3' two-thirds of the URA3 cassette. A second plasmid (p2) was constructed with the 5' two-thirds of the URA3 cassette (such that there was ~500 bases overlap with p1) and the integration site 3' homology arm. This strategy decreases the rate of unwanted recombination events because only when both halves integrate into the same site will a functional URA3 cassette be formed. All PCR reactions were performed using NEB Q5 high fidelity polymerase according to manufacturer's instructions. Plasmids were assembled using NEBuilder HiFi assembly mix according to manufacturer's instructions, routinely using 30 base pair overlaps to facilitate assembly. The URA3 cassette is flanked by loxP sites to facilitate removal of the marker by expression of Cre recombinase. Genes encoding for enzymes with SEQ ID NOS: 308-312 were evaluated for their IPMS activity.

Plasmids shown in Table 1 were assembled using NEBuilder HiFi assembly mix according to manufacturer's instructions, routinely using 30 base pair overlaps to facilitate assembly. IPMS genes were inserted into two separate intergenic loci on chromosome A (NC_042506). Intergenic locus A2193833 (aka igA2.2) and A1207782 (aka igA1.2).

TABLE 1

Relevant plasmids used to modify strains in this example

| Plasmid | Use | Genotype/relevant genes |
|---|---|---|
| pSB011 | Insert IPMS cassette and ura3 marker into io intergenic locus igA2.2 | 5' HA igA2.2, ioTDH3p-SEQ ID NO: 308-ioTKLt; lox66-ioTALt-ura3 3' |
| pSB012 | Insert IPMS cassette and ura3 marker into io intergenic locus igA2.2 | 5' HA igA2.2, ioTDH3p-SEQ ID NO: 309-ioTKLt; lox66-ioTALt-ura3 3'v |
| pSB013 | Insert IPMS cassette and ura3 marker into io intergenic locus igA2.2 | 5' HA igA2.2, ioTDH3p-SEQ ID NO: 310-ioTKLt; lox66-ioTALt-ura3 3'v |
| pSB014 | Insert IPMS cassette and ura3 marker into io intergenic locus igA2.2 | 5' HA igA2.2, ioTDH3p-SEQ ID NO: 311-ioTKLt; lox66-ioTALt-ura3 3' |
| pSB015 | Insert IPMS cassette and ura3 marker into io intergenic locus igA2.2 | 5' HA igA2.2, ioTDH3p-SEQ ID NO: 312-ioTKLt; lox66-ioTALt-ura3 3'v |
| pSB017 | Insert IPMS cassette and ura3 marker into io intergenic locus igA2.2 | Ura3 5'-ioPGKp-lox71, 3' HA igA2.2 |
| pSB019 | Insert IPMS cassette and ura3 marker into io intergenic locus igA1.2 | 5' HA igA1.2, ioTDH3p-*C. glutamicum* leuA B018-ioTKLt; lox66-ioTALt-ura3 3' |
| pSB020 | Insert IPMS cassette and ura3 marker into io intergenic locus igA1.2 | 5' HA igA1.2, ioTDH3p-*C. glutamicum* leuA CP-ioTKLt; lox66-ioTALt-ura3 3' |
| pSB021 | Insert IPMS cassette and ura3 marker into io intergenic locus igA1.2 | Ura3 5'-ioPGKp-lox71, 3' HA igA1.2 |
| pEC010 | Express Cre recombinase in io strains | ioPGKp-cre-CYC1t; KanMX, ioCEN0.8, ioARS |

To construct pSB011-15 the 5' homology arm and ioTDH3 promoter were PCR amplified with primers shown in SEQ ID NO: 321 and SEQ ID NO: 322 and SEQ ID NO: 323 and SEQ ID NO: 324 respectively, using SB502 genomic DNA as template. The IPMS genes were codon optimized for *Issatchenkia orientalis* and synthesized as gene fragments by Twist Biosciences (San Francisco, CA). The genes needed to be split into two fragments because of their length and complexity. The ioTKL terminator & 3' portion of the URA3 cassette and vector backbone (pTwist-Kan high copy), were PCR amplified from a plasmid synthesized by Twist Biosciences. To construct pSB017 the 3' homology arm was amplified using primers SEQ ID NO: 325 and SEQ ID NO: 326 and SB502 genomic DNA as template. The 5' portion of the URA3 cassette and vector backbone was amplified using primers ig2.2p2 gib vec F+R and plasmid ig1.6p2 as template. Clones were screened by PCR and/or restriction digest for proper assembly and sequences were confirmed via Sanger sequencing. The p1 and p2 inserts were liberated from their vector backbones via restriction digest and inserts purified via gel extraction (NEB Monarch gel purification kit) to be transformed into suitable yeast strain.

All transformations were performed using the lithium acetate method as described in Geitz & Schiestl, 2007, Nature Protocols, 31-34. Individual transformants were screened using colony PCR to confirm correct integration of the 5' flank (using primers SEQ ID NO: 327 and SEQ ID NO: 328) and 3' flank (using primers SEQ ID NO: 329 and SEQ ID NO: 330) and to confirm correct assembly of the ura3 marker (using primers SEQ ID NO: 331 and SEQ ID NO: 332) and presence of the gene of interest (SEQ ID NO: 333 and SEQ ID NO: 334). Primers amplifying the native integration site (SEQ ID NO: 327 and SEQ ID NO: 329) were also used to identify any heterozygosity. The resulting strains containing a single copy of a gene encoding enzymes with SED ID NOs: 308-312, designated SB507-SB511, respectively, were assayed for IPMS activity. The activity was determined by measuring the amount of free CoA liberated as described in Kohlhaw and Leary, 1969, Vol. 244, No. 8 pp. 2218-2225. Total protein concentration in cell lysates was measured using Bradford assay. The recorded activity from these strains is expressed in nmol/mg prot/min and shown in Table 2.

TABLE 2

Enzyme activity in yeast strains

| Strain | Sequence | Activity |
|---|---|---|
| SB507 | SEQ ID NO: 308 | 86.5 |
| SB508 | SEQ ID NO: 309 | 56.0 |
| SB509 | SEQ ID NO: 310 | 25.5 |
| SB510 | SEQ ID NO: 311 | 89.3 |
| SB511 | SEQ ID NO: 312 | 5.4 |
| SB512 | Control | 5.5 |

As illustrated in Table 2, even a single copy of the gene could significantly enhance enzyme activity. Strains SB507 and SB510 were selected for inserting a second copy of the gene to make the locus homozygous. These strains were transformed with 1 μg of pEC010 plasmid containing a Cre expression cassette and KanMX cassette conferring resistance to Geneticin. Transformants were plated on YPD+500 ug/mL G418-sulfate. A single colony was used to inoculate YPD broth+500 ug/mL G418-sulfate and grown overnight. The G418 culture was then used to inoculate SC+1 g/L 5-FOA which selected for clones that had lost the ura3 marker. The 5-FOA culture was grown for 24-48 hours until visible growth was observed then cells were streaked for isolation onto a YPD plate. Single colonies were replica plated onto YPD, YPD+G418500 and SC-Ura plates. Clones that did not grow in the presence of G418 (had lost pEC010) or SC-Ura (lacked URA3) were screened via colony PCR to confirm URA3 loop-out. The second copy of the gene was integrated in a second round of transformation using the same p 1 and p2 constructs. Successful integration and homozygosity were confirmed using colony PCR. The resulting strain was rendered auxotrophic for uracil by repeating the method described above, to facilitate further modification. In the manner described above, the other genes in the βHIV metabolic pathway shown in FIG. 1 were inserted subsequently. Sequences of exemplary enzymes that catalyze various steps of the βHIV metabolic pathway are step (b): SEQ ID NO: 297, SEQ ID NO: 298, SEQ ID NO: 299, SEQ ID NO: 300 step (c): SEQ ID NO: 301, SEQ ID NO: 302, SEQ ID NO: 303, step (d): SEQ ID NO: 304, SEQ ID NO: 305, SEQ ID NO: 306, SEQ ID NO: 307, step (f): SEQ ID NO: 314, SEQ ID NO: 315 and step (g): SEQ ID NO: 316, SEQ ID NO: 317, SEQ ID NO: 318, SEQ ID NO: 319, SEQ ID NO: 320. Therefore, the resulting yeast strains have the multiple variations of the βHIV metabolic pathway leading up to KIC.

A strain, designated SB553, comprising homozygous integration of genes that encode for SEQ ID NO: 299, SEQ ID NO: 301, SEQ ID NO: 304, SEQ ID NO: 308, SEQ ID NO: 315 and SEQ ID NO: 319, was grown in 50 mL of yeast minimal salts medium supplemented with 40 mg/L of uracil, trace metals, vitamins and glucose as the carbon source (Verduyn, et al. Yeast 8, 7: 501-517, 1992). After 44 h of growth, the yeast culture was harvested and centrifuged to remove the yeast cells. The clarified supernatants were analyzed for residual glucose and βHIV synthesis via HPLC as described in Example 2. The strain SB502 was also grown under identical conditions to serve as a control. SB502 produced only 0.32 g/L of KIC while SB553 produced 1.84 g/L of KIC. Increased KIC production is clearly illustrative of the increased activity of all the enzymes expressed or overexpressed in the yeast cytosol.

Example 4: Production of βHIV in Yeast

Figure 5:
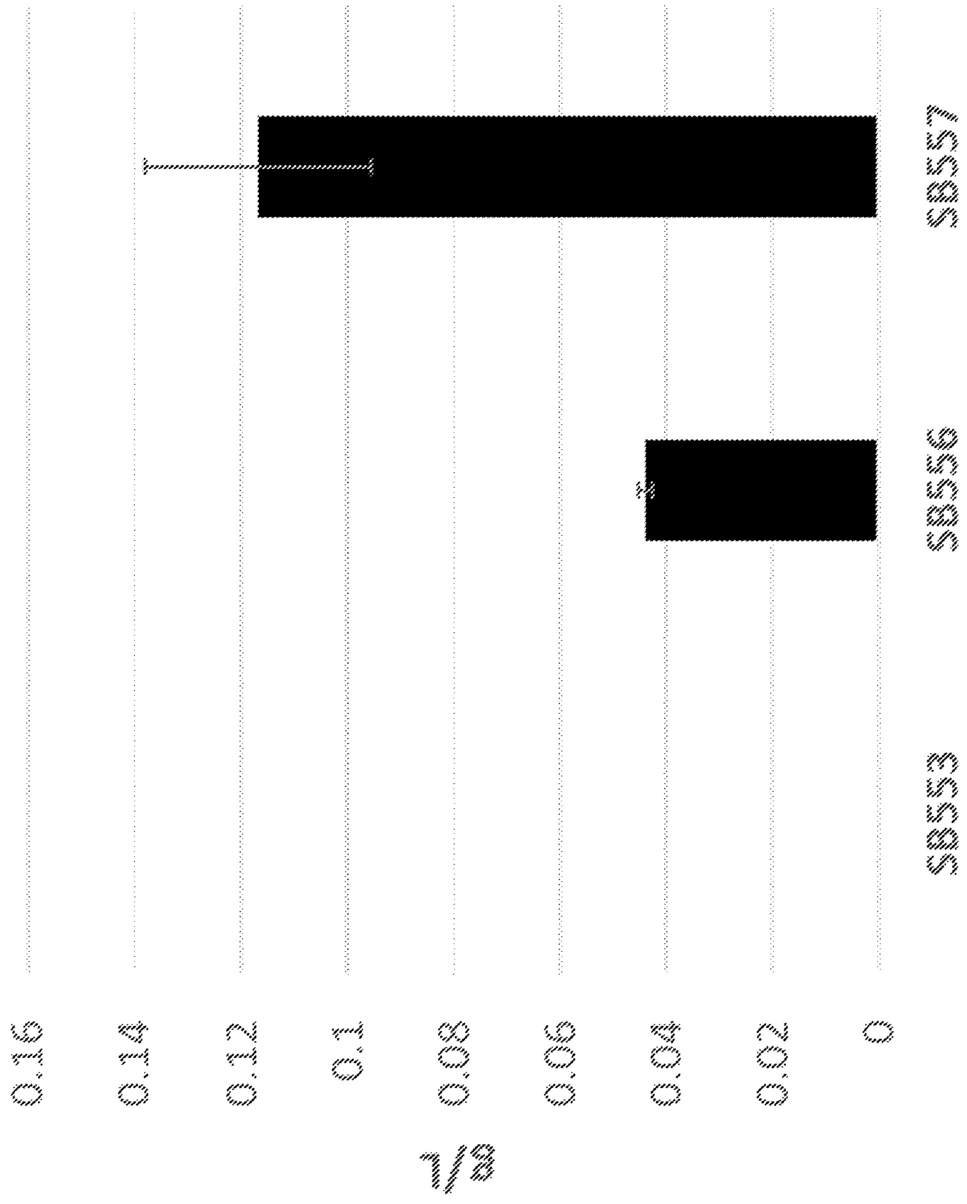
FIG. 5 is a bar graph illustrating the accumulation of βHIV by non-natural yeast microorganism harboring an unmodified dioxygenase enzyme (SB556) or an improved βHIV synthase (SB557), according to certain embodiments of the present invention.

This example will illustrate the integration of the complete βHIV metabolic pathway that will result in βHIV production by a non-natural yeast. All genetic manipulations were carried out using the methods described in Example 3. Step (a) of the βHIV metabolic pathway shown in FIG. 1, encoding for βHIV synthase, was assembled in strain SB553. Codon-optimized sequences of genes that encode for βHIV synthase variants corresponding to SEQ ID NO: 1 and SEQ ID NO: 335 were chromosomally integrated in SB553 to result in strains SB556 and SB557. The three strains were grown under identical conditions using minimal salts medium described in Example 3. After 42 h of growth, the culture was harvested, and cells separated by centrifugation. The clarified supernatant was analyzed for βHIV using an HPLC as described in Example 3. As illustrated in FIG. 5, supernatant from SB553 did not have any detectable βHIV. However, SB556 supernatant had 0.04 g/L of βHIV and SB557 supernatant had 0.12 g/L of βHIV. The result confirms the conversion of glucose into βHIV in SB556 and SB557 yeast using the metabolic pathway shown in FIG. 1 and the ability of the yeast cell to export βHIV into the medium using a transporter. Furthermore, the result also illustrates increased βHIV production using different variants of βHIV.

Various embodiments of systems, devices, and methods have been described herein. These embodiments are given only by way of example and are not intended to limit the scope of the claimed inventions. It should be appreciated, moreover, that the various features of the embodiments that have been described may be combined in various ways to produce numerous additional embodiments. Moreover, while various materials, dimensions, shapes, configurations and locations, etc. have been described for use with disclosed embodiments, others besides those disclosed may be utilized without exceeding the scope of the claimed inventions.

Persons of ordinary skill in the relevant arts will recognize that the subject matter hereof may comprise fewer features than illustrated in any individual embodiment described above. The embodiments described herein are not meant to be an exhaustive presentation of the ways in which the various features of the subject matter hereof may be combined. Accordingly, the embodiments are not mutually exclusive combinations of features; rather, the various embodiments can comprise a combination of different individual features selected from different individual embodiments, as understood by persons of ordinary skill in the art. Moreover, elements described with respect to one embodiment can be implemented in other embodiments even when not described in such embodiments unless otherwise noted.

Although a dependent claim may refer in the claims to a specific combination with one or more other claims, other embodiments can also include a combination of the dependent claim with the subject matter of each other dependent claim or a combination of one or more features with other dependent or independent claims. Such combinations are proposed herein unless it is stated that a specific combination is not intended.

Any incorporation by reference of documents above is limited such that no subject matter is incorporated that is contrary to the explicit disclosure herein. Any incorporation by reference of documents above is further limited such that no claims included in the documents are incorporated by reference herein. Any incorporation by reference of documents above is yet further limited such that any definitions provided in the documents are not incorporated by reference herein unless expressly included herein.

For purposes of interpreting the claims, it is expressly intended that the provisions of 35 U.S.C. § 112(f) are not to be invoked unless the specific terms "means for" or "step for" are recited in a claim.

SEQUENCE LISTING (335 sequences)

SEQ ID NO: 1 - protein, 393 aa, Rattus norvegicus
MTTYSNKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRGNLTDLETNGVRSGM

SEQ ID NO: 2 - protein, 377 aa, Rattus norvegicus
MYWDKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRG

SEQ ID NO: 3 - protein, 354 aa, Rattus norvegicus
MGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPRYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPPSYYRLLRENLKSAKIQVKEDMDVLEELKILVDYDEKGYLLQIFTKPMQDRPTLFLEVIQRHNHQGFGAGNFNSLFKAFEEEQALRGNLTDLETNGVRSGM

SEQ ID NO: 4 - protein, 394 aa, Yarrowia lipolytica
MSPSVEVTPAHTPTSYEVTNSLDSYRGYDHVHWYVGNAKQAASFYITRMGFSPIAYKGLETGSRDVTTHVVGNGQVRFAFSSALRTGEPQADEIHAHLVKHGDAVKDVAFEVDNVEQLFSAAVKKGVRVISEPKVLKDAHGSVTYAVISTYGDTTHTLIERGSYEGAFLPGFVDTSANKDPIAAFLPNIELMHIDHCVGNQDWNEMDNACKYYEETLGFHRFWSVDDKDICTEFSALKSVVMASPNEKIKMPVNEPAVGKKKSQIEEYIDFYDGPGIQHIALRTDCILDTVRDLRARGVEFISVPGSYYENMKERLAKSSLKLEEKFEDIQALNILIDFDEGGYLLQLFTKPLMDRPTVFIEIIQRRNFEGFGAGNFKSLFEAIEREQAKRGNL

SEQ ID NO: 5 - protein, 394 aa, Yarrowia lipolytica
MSPSVEVTPAHTPTSYEVTNSLDSYRGYDHVHWYVGNAKQAASFYITRMGFSPIAYKGLETGSRDVTTHVVGNGQVRFAFSSALRTGEPQADEIHAHLVKHGDAVKDVAFEVDNVEQLFSAAVKKGVRVISEPKVLKDAQGSVTYAVISTYGDTTHTLIERGSYEGAFLPGFVDTSANKDPIAAFLPNIELMHIDHCVGNQDWNEMDNACKYYEETLGFHRFWSVDDKDICTEFSALKSVVMASPNEKIKMPVNEPAVGKKKSQIEEYIDFYDGPGIQHIALRTDCILDTVRDLRARGVEFISVPGSYYENMKERLAKSSLKLEEKFEDIQALNILIDFDEGGYLLQLFTKPLMDRPTVFIEIIQRRNFEGFGAGNFKSLFEAIEREQAKRGNL

SEQ ID NO: 6 - protein, 393 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 7 - protein, 377 aa, Homo sapiens
WYWDKGPKPERGRFLHFHSVTFWVGNAKQAASFYCNKMGFEPLAYKGLETGSREVVSHVVKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTICHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRG

SEQ ID NO: 8 - protein, 375 aa, Homo sapiens [sequence omitted]

SEQ ID NO: 9 - protein, 376 aa, Rattus norvegicus
YWDKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRG

SEQ ID NO: 10 - protein, 393 aa, Mus musculus domesticus
MTTYNNKGPKPERGRFLHFHSVTFWVGNAKQAASFYCNKMGFEPLAYRGLETGSREVVSHVIKRGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRGNLTDLEPNGVRSGM

SEQ ID NO: 11 - protein, 379 aa, Mus musculus
TVDYWDKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCNHIVQKARERGAKIVRDAWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRG

SEQ ID NO: 12 - protein, 393 aa, Homo sapiens [sequence omitted]

SEQ ID NO: 13 - protein, 393 aa, Rattus norvegicus; identical to SEQ ID NO: 1

SEQ ID NO: 14 - protein, 393 aa, Mus musculus
MTTYNNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRGNLTDLEPNGVRSGM

SEQ ID NO: 15 - protein, 393 aa, Bos taurus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRPTLFLEVIQRHNHQGFGAGNFNSLFKAFEEEQDLRGNLTDMEPNGVVSGM

SEQ ID NO: 16 - protein, 393 aa, Mus musculus
MTTYNNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQSHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRGNLTDLEPNGVRSGM

SEQ ID NO: 17 - protein, 377 aa, Homo sapiens; identical to SEQ ID NO: 7

SEQ ID NO: 18 - protein, 393 aa, Pan troglodytes
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 19 - protein, 393 aa, Cricetulus griseus
MTTYTNKGPKPERGRFLHFHSVTFWVGNAKQAASFYCNKMGFEPLAYRGLETGSREVVSHVIKQGKIVFVFCSALNPWNKEMGDHLVKHGDGVKDIAFEVEDCDHIVQKARERGAKIVREPWVEEDKFGKVKFAVLQTYGDTTHTLVEKINYTGRFLPGFEAPTYKDTLLPKLPRCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRENLKTAKIQVKESLDVLEELKILVDYDEKGYLLQIFTKPMQDRPTLFLEVIQRRNHQGFGAGNFNSLFKAFEEEQALRGNLTDMETNGVRSGM

SEQ ID NO: 20 - protein, 393 aa, Saimiri boliviensis boliviensis
MTTYSDKGAKPERGRFLHFHSVTFWVGNAKQAASFYCTKMGFEPLAYRGLETGSREVVSHVIKQGKIVFVLSSALNPWNKEMGNHLVKHGDGVKDIAFEVEDCDYIVQKARERGAKIVREPWVEEDKFGKVKFAVLQTYGDTTHTLVEKMSYAGRFLPGYEAPAFMDPLLPQLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRERGMEFLSVPSTYYKQLREKLKVAKIKVKESIDVLEELKILVDYDEKGYLLQIFTKPVQDRPTLFLEVIQRHNHQGFGAGNFNSLFKAFEEEQNLRGNLTNMETDGVVPGM

SEQ ID NO: 21 - protein, 393 aa, Felis catus
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIAQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLFLEVIQRHNHQGFGAGNFNSLFKAFEEEQNLRGNLTDLENNGIVPGM

SEQ ID NO: 22 - protein, 393 aa, Ovis aries
MTTYSDKGEKPERGRFLHFHSVTFWVGNAKQAASYYCSKLGFEPLAYKGLETGSREVVSHVVKQGQIVFIFSSALNPWNKEMGDHLVKHGDGVKDIAFEVEDCDYIVQKARERGAKIVREPWVEQDKLGKVKFAVLQTYGDTTHTLVEKMNYTGRFLPGFEAPAFMDPQLSKLPNCGLEIIDHIVGNQPDQEMVSASEWYLKNLQFHRFWSVDDTQVHTEYSSLRSIVVANYEESIKMPINEPAPGKKKSQIQEYVDYNGGAGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNSLFKAFEEEQDLRGNLTDMEPNGVVSSM

SEQ ID NO: 23 - protein, 393 aa, Orcinus orca
MTTYSNKGEKPERGRFLHFHSVTFWVGNAKQAASYYCSKMGFESLAYKGLETGSRETVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLPKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVPSM

SEQ ID NO: 24 - protein, 393 aa, Odobenus rosmarus divergens
MTTYSDKGRKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGWFLPGFETPASVDPLLSKLPTCSLEIIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDILEELKILVDYDEKGYLLQIFTKPMQDRPTLFLEVIQRHNHQGFGAGNFNSLFKAFEEEQDLRGNLTDLKNTRTLPGM

SEQ ID NO: 25 - protein, 393 aa, Dasypus novemcinctus
MTTYSDKGVKPERGRFLHFHSVTFWVGNAKQAASFYCNKMGFEPLAYRGLETGSREVVSHVVKQDKIVFVLSSALNPGNKEMGDHLVKHGDGVKDIAFEVEDCASIVQKARERGAKIVREPWVEEDKFGKVKFAVLQTYGDTTHTLVEKMNYTGRFLPGFEAPVITDPLLAKLPSCRLEIIDHIVGNQPDQEMVSASEWYVKNLQFHRFWSVDDTQVHTEYSSLRSIVVANYEETIKMPINEPAQGKKKSQIQEYVDYNGGAGVQHIALKTQDIITAIRHLKERGLEFLAVPSTYYRQLREKLKTAKIKVKESIDILEELKILVDFDEKGYLLQIFTKPVQDRPTLFLEVIQRHNHQGFGAGNFNSLFKAFEEEQKLRGNLTDLGANGVLPGM

SEQ ID NO: 26 - protein, 393 aa, Jaculus jaculus
MTTYSDKGPKPERGRFLHFHSVTFWVGNAKQAASFYCNKMGFEPLAYKGLETGSREVVSHVIKQGKIVFVLSSALNPWNKEMGDHLVKHGDGVKDIAFEVEDCEHIVQKARERGAKIVREPWVEQDRFGKVKFAVLQTYGDTTHTLVEKINYTGRFLPGFEAPMLKDPLLSKLPNCSLEIIDHIVGNQPDQEMESASEWYLKNLQFHRFWSVDDTQVHTEYSSLRSIVVANYEESIKMPINEPAPGKKKSQIQEYVDYNGGAGVQHIALKTQDIITTIRHLRERGMEFLAVPSTYYKLLRENLKSAKIRVKESIDVLEELKILVDYDENGYLLQIFTKPMQDRPTLFLEVIQRHNHQGFGAGNFNSLFKAFEEEQALRGNLTDMETNGVVSGM

SEQ ID NO: 27 - protein, 393 aa, Mustela putorius furo
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYLVQKAREQGAKIVREPWIEQDKFGKVKLAVLQTYGDTTHTLVEKMNYTGRFLPGFEAPISVDPLLSKLPTCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLKARGMEFLGVPSSYYKQLREKLKTAKIQVKENIDVLEELKILVDYDEKGYLLQIFTKPMQDRPTLFLEVIQRHNHQGFGAGNFNALFKAFEEEQDLRGNLTNLETNSSLRGM

SEQ ID NO: 28 - protein, 393 aa, Heterocephalus glaber
MTTYSDKGAKPERGRFLHFHSVTFWVGNAKQAAAFYCSKMGFEPLAYRGLETGSREVASHVIKQGQIVFVLSSPLNPWNREMGEHLVKHGDSVKDIAFEVEDCDYIVQKARERGAKVVREPWVEEDKFGKVKLAVLQTYGDTTHTLVEKMSFSGSFLPGFEAPRVKDSLLSKLPSCGLETIDHIVGNQPDQEMVSASEWYLRNLQFHRFWSVDDSQVHTEYSALRSIVVTNYEESIKMPINEPALGRKKSQIQEYVEYNGGAGVQHIALKTPDIITSIRHLRERGVEFLAVPSTYYKQLRENLKSAKIRVKESIDMLEELKILVDYDEKGYLLQVFTKPVQDRPTLFLEVIQRHNHQGFGAGNFNALFKAFEAEQDLRGNLTDTETNGVVSGV

SEQ ID NO: 29 - protein, 393 aa, Microtus ochrogaster
MTTYTNKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGHFLPGFEAPVYKDTLLPKLPRCNLEVIDHIVGNQPDQEMVSASEWYLKNLQFHRFWSVDDTQVHTEYSSLRSIVVANYEESIKMPINEPAPGKKKSQIQEYVDYNGGAGVQHIALKTDDIITAIHHLRERGMEFLAVPSSYYKLLRENLKTAKIQVKESMDTLEELKILVDYDEKGYLLQIFTKPMQDRPTLFLEVIQRHNHQGFGAGNFNSLFKAFEEEQALRGNLTDLETNGVRSGK

SEQ ID NO: 30 - protein, 393 aa, Chinchilla lanigera
MTTYSDKGAKPERGRFLHFHSVTFWVGNAKQAASFYCSKMGFEPLAYRGLETGSREVASHVIKQGQIVFVFSSPLNPWNKEMGDHLVKHGDGVKDIAFEVEDCDYIVQKARERGAKVVREPWVEQDKSGKVKFAVLQTYGDTTHTLVEKTGYSGSFLPGFEAARAKDSLLSKLPSCGLEIIDHIVGNQPDQEMLSASEWYLRNLQFHRFWSVDDTQVHTEYSSLRSIVVTDYEESIKMPINEPAPGKKKSQIQEYVDYNGGAGVQHIALKTQDIITAIRHLRERGAEFLAVPSSYYTQLRENLKSAKVRVKENIDVLEELKILVDYDEKGYLLQIFTKPMQDRPTLFLEVIQRHNHQGFGAGNFNALFKAFEAEQDLRGNLTDLETNGVASGM

SEQ ID NO: 31 - protein, 393 aa, Macaca fascicularis
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKAREQGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITTIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 32 - protein, 393 aa, Equus caballus
MTTYSNKGEKPEKGRFLHFHSVTFWVGNAKQAASFYCNKLGFEPLAYKGLETGSREVVSHVIKQGKIIFVFSSALNPWNKEMGDHLVKHGDGVKDIAFEVEDCDYIVQKARERGAKIVREPWVEQDKFGKVKFAVLQTYGDTTHTLVEKMSYAGRFLPGFEAPAFRDPLLSKLPNCSLEIIDHVVGNQPDHEMESASEWYLKNLQFHRFWSVDDTQVHTEYSSLRSIVVANYEESIKMPINEPAPGRKKSQIQEYVDYNGGAGVQHIALKTHDIITAIRHLRERGMEFLAVPSSYYRQLQEKLKSAKIRVKESIDVLEELKILVDYDEKGYLLQIFTKPTQDRPTLFLEVIQRHNHQGFGAGNFNALFKAFEEEQDLRGNLTDMQTNDLVPGK

SEQ ID NO: 33 - protein, 393 aa, Bos mutus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRTTIFLEVIQRHNHQGFGAGNFNSLFKAFEEEQDLRGNLTDMEPNGVVSGM

SEQ ID NO: 34 - protein, 390 aa, Vicugna pacos
MTTYSNKGEKPERGRFLHFHSVTFWVGNAKQAASYYCSKMGFEPLAYKGLETRSREVVSHVIKQGKIVFVFSSALNPWNKEMGDHLVKHGDGVKDIAFEVEDCDYIVQKARERGAKIVREPWVEQDKFGKVKFAVLQTYGDTTHTLVEKMNYTGRFLPGFEAPASTDPLLSKLPNCGLEIIDHIVGNQPDQEMLSASEWYLKNLQFHRFWSVDDTQVHTEYSSLRSIVVANYEESIKMPINEPAPGRKKSQIQEYVDYNGGAGVQHIALKTQDIITAIRHLRERGMEFLAVPSTYYKQLREKLKSAKIRVKENIDVLEELKILVDYDEKGYLLQIFTKPMQDRPTLFLEVIQRHNHQGFGAGNFNSLFKAFEEEQDLRGNLTDMETSGVV

SEQ ID NO: 35 - protein, 393 aa, Myotis davidii
MTSYSNKGEKPERGRFLHFHSVTFWVGNAKQAASFYCSKMGFKPIAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYAGFFLPGFEPTTNRDQALSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKENLDALEELKILVDYDENGYLLQIFTKPMQDRPTLFLEVIQRHNHQGFGAGNFNALFKAFEEEQNMRGNLTDLEPNGVIRGM

SEQ ID NO: 36 - protein, 393 aa, Leptonychotes weddellii
MTTYSDKGKKPQRGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGRFLPGFETPASVDPLLSKLPSCSLEMIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPMYYKQLREKLKSAKIRVKESIDTLEELKILVDYDEKGYLLQIFTKPMQDRPTLFLEVIQRHNHQGFGAGNFNSLFKAFEEEQDLRGNLTDLENTRTLPGM

SEQ ID NO: 37 - protein, 393 aa, Peromyscus maniculatus bairdii
MTSYTNKGPKPERGRFLHFHSVTFWVGNAKQAASFYCNKMGFEPLAYKGLETGSREVVSHVIKQGKIVFVLSSALNPWNKEMGDHLVKHGDGVKDIAFEVEDCEHIVQKARERGAKIVREPWVEQDKFGKVKFAVLQTYGDTTHTLVEKINYTGRFLPGFEAPMHKDTLLSKLPSCNLEVIDHIVGNQPDQEMLSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYRLLRENLKTAKIQVKESMDVLEELKILVDYDEKGYLLQIFTKPMQDRPTLFLEVIQRHNHQGFGAGNFNSLFKAFEEEQALRGNLTDLETNGVRSGM

SEQ ID NO: 38 - protein, 393 aa, Panthera tigris altaica
MTTYSNKGEKPARGRFLHFHSVTFWVGNAKQAASFYCNKMGFEPLAYKGLETGSREVVSHAIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLSLEVIQRHKHQGFGAGNFNSLFKAFEEEQNLRGNLTDLENNGIVPGM

SEQ ID NO: 39 - protein, 393 aa, Physeter catodon
MTTYSNKGEKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGRVKFAVLQTYGDTTHTLVEKMNYTGWFLPGFEAPAFVDPLLSKLPNCSLEIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPFTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGVGSGM

SEQ ID NO: 40 - protein, 393 aa, Bubalus bubalis
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNSLFKAFEEEQDLRGNLTDMEPNGVVSGM

SEQ ID NO: 41 - protein, 393 aa, Balaenoptera acutorostrata scammoni
MTTYSNKGQKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLKIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIHHLRERGMEFLAVPSTYYKQLREKLKTAKIRVKENIDVLEELKILVDYDEKGYLLQIFTKPMQDRPTLFLEVIQRYNHQGFGAGNFNSLFKAFEEEQDLRGNLTDMETNGLVPGM

SEQ ID NO: 42 - protein, 393 aa, Lipotes vexillifer
  misc_feature (348)..(349): Xaa can be any naturally occurring amino acid
MTTYSNKGEKPEKGRFLHFHSVTFWVGNAKQAASYYCSKMGFEPLAYKGLETGSREMVSHVIKQGKIAFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPGFVDPLLSKLPNCSLEIIDHIVGNQPDQEMLSASEWYLKNLQFHRFWSVDDTQVHTEYSSLRSIVVANYEESIKMPINEPAPGRKKSQIQEYVDYNGGAGVQHVALKTEDIITAIRHLRERGMEFLAVPSTYYKQLREKLKSAKIRVKENIDVLEELKILVDYDEKGYLLQIFTKPMQDRPTLFXXVIQRYNHQGFGAGNFNSLFKAFEEEQDLRGNLTDMETNGTTCGM

SEQ ID NO: 43 - protein, 420 aa, Carlito syrichta
MRPRLDQKLPGLGPCRPRLSSRPHEGHQTTYSNKGPKPERGRFLHFHSVTFWVGNAKQAASFYCNKMGFEPFAYRGLETGAREVVSHVIKQGKIVFVLSSALNPWNKEMGDHLVKHGDGVKDITFEVEDCDSIVQKARERGAKIVREPWVEQDKFGKVKFAVLQTYGDTTHTLVEKVNYTGRFLPGFEAPVMTDPLLSKLPNCHLEIIDHIVGNQPDQEMVSASEWYLKNLQFHRFWSVDDKQVHTEYSSLRSVVVANYEESIKMPINEPAPGKKKSQIQEFVEYNGGAGVQHIALKTQDIITSIRHLRERGTEFLAVPSTYYKQIREKLKTAKIKVKENIDILEELRILVDYDEKGYLLQIFTKPMQDRPTLFLEIIQRHNHQGFGAGNFNALFKAFEEEQDLRGNLIDVNTNGVVPGM

SEQ ID NO: 44 - protein, 393 aa, Oryctolagus cuniculus
MTTYSDKGAKPERGRFLHFHSVTFWVGNAKQAASFYCTKMGFEPLAYRGLETGSRQVVSHVIKQGQIVFVLSSALNPGNKEMGDHLVKHGDGVKDIAFEVEDCDYIVQKARERGAKILREPWVEQDKFGKVKFAVLQTYGDTTHTLVEKMNYTGRFLPGFEAPMSKDPLLSKLPSCSLEIIDHIVGNQPEQEMVSASEWYLRNLQFHRFWSVDDTQVHTEYSSLRSIVVANYEESIKMPINEPAPGRKKSQIQEYVDYNGGAGVQHIALKTHDIISAIRHLRERGMEFLAVPATYYKQLREKLRSAKIRVTESIDVLEELKILVDYDEKGYLLQIFTKPMQDRPTLFLEVIQRHNHQGFGAGNFNSLFKAFEEEQNLRGNLTDMETNGVVPGM

SEQ ID NO: 45 - protein, 393 aa, Galeopterus variegatus
MTTYSNKGEKPERGRFLHFHSVTFWVGNAKQAASFYCSKMGFKPLAYKGLETGSREVVSHVIQQGKIVFVLSSALNPWNTEMGDHLVKHGDGVKDIAFEVEDCDYIVQKAQERGAKIMREPWVEQDKFGKVKFAVLQTYGDTTHTLVEKMNYSGRFLPGFEAPAFTDPLLSKLPDCCLEIIDHVVGNQPDQEMVSASEWYVKNLQFHRFWSVDDTQVHTEYSSLRSIVVANYEETIKMPINEPAQGKKKSQIQEYVDYNGGPGVQHIALKTQDIITAIRHLRERGLEFLGVPSTYYKQLREKLKSAKIRVKESIDVLEELKILVDYDEKGYLLQIFTKPMQDRPTLFLEVIQRHNHQGFGAGNFNSLFKAFEEEQDLRGNLTDLETNGVGPGI

SEQ ID NO: 46 - protein, 393 aa, Nannospalax galili
MTTYSNKGPKPERGRFLHFHSVTFWVGNAKQAASFYCNKMGFEPLAYKGLETGSREVVSHVIKQGKIVFVLCSALNPWNKEMGNHLVKHGDGVKDIAFEVEDCDHIVQKARERGAKIVREPWVEQDKFGKVKFAVLQTYGDTTHTLVEKMNYTGCFLPGFEAPTYKDPLLSKLPNCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGMEFLAVPSSYYKLLRENLKTARIQVKESIDVLEELKILVDYDDKGYLLQIFTKPMQDRPTLFLEVIQRHNHQGFGAGNFNSLFKAFEEEQALRGNLTDTGTNRVMSGM

SEQ ID NO: 47 - protein, 393 aa, Mesitornis unicolor
QTTYTDKGEKPLRGRFIHFHSITFWVGNAKQAASYYCNKLGFEELAYRGLETGSREVVSHVIKQDKIVFVLSSALNPGNEEMGEHLVKHGDGVKDIAFEVEDCDFIVQKARERGAVVVKEPWVEEDKFGKVKFAVIQTYGDTTHTLVEKLNYKGLFLPGYHQPLFKDPLLPKLPSAKLSFVDHVVGNQPDLQMVPVADWYQKNLLFHRFWSVDDKQLHTEFSALRSIVVTNYEETIKMPINEPAFGKKKSQIQEYIDYYGGAGVQHIALNTSDIISAITNLKQRGMQFMDVPSSYYQVLRERLKTAKIKVKENIDKLAELKILVDFDEKGYLLQIFTKPVQDRPTVFLEVIQRHNHQGFGAGNFKSLFEAIEMDQDARGNLTILEPNGETKRI

SEQ ID NO: 48 - protein, 425 aa, Rhinopithecus roxellana
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGISASWQPREGQGGRQRSGTEEPRVPALCQEGSH

SEQ ID NO: 49 - protein, 393 aa, Fukomys damarensis
MTTYSDKGAKPERGRFLHFHSVTFWVGNAKQAAAFYCSKMGFEPLAYRGLETGSREVASHVIKQGQIVFVLSSPLNPWNREMGEHLAKHGDSVKDIGFEVEDCDYIVQKARERGAKVVREPWVEQDKFGKVKFAVLQTYGDTTHTLVEKVNYSGSFLPGFEAPRAKDPLLAKLPSCSLEMIDHIVGNQPDQEMVSASEWYLRSLQFHRFWSVDDTQVHTEYSSLRSIVVTNYEESIKMPINEPAPGKKKSQIQEYVDYNGGAGVQHIALGTQDIITSIRHLRERGVEFLAVPSTYYKQLRENLKSAKVQVKESIDMLEELKILVDYDEKGYLLQIFTKPVQDRPTLFLEVIQRHNHQGFGAGNFNALFKAFEAEQDLRGNLTDVETNGVESGL

SEQ ID NO: 50 - protein, 407 aa, Colobus angolensis palliatus
MPFEGQLHLIDSLTKTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSVVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 51 - protein, 393 aa, Colobus angolensis palliatus
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSVVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 52 - protein, 393 aa, Mandrillus leucophaeus
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 53 - protein, 393 aa, Macaca nemestrina
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKAREQGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 54 - protein, 393 aa, Aotus nancymaae
MTTYSDKGAKPERGRFLHFHSVTFWVGNAKQAASFYCTKMGFEPLAYRGLETGSREVVSHVIKQGKIVFVLSSALNPWDKEMGDHLVKHGDGVKDIAFEVEDCDYIVQKARERGAKIVREPWVEEDKFGKVKFAVLQTYGDTTHTLVEKMNYAGRFLPGYEAPVFMDPLLPQLPKCSLEVIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRERGMEFLSVPSTYYKQLREKLKVAKIKVKESIDVLEELKILVDYDEKGYLLQIFTKPVQDRPTLFLEVIQRHNHQGFGAGNFNSLFKAFEEEQNLRGNLTNMETDGVVPGM

SEQ ID NO: 55 - protein, 393 aa, Propithecus coquereli
MTTYSNKGAKPERGRFLHFHSVTFWVGNAKQAAAFYCSKMGFEPLAYRGLETGSREVVSHAIKQGQIVFVLSSALNPWNKEMGDHLVKHGDGVKDIAFEVEDCDYIVQKAWERGAKIVREPWVEQDKFGKVKFAVLQTYGDTTHTLVEKMNYTGRFLPGFEAPMFKDLLLSRLPSCSLEIIDHIVGNQPDQEMVPASEWYLKNLQFHRFWSVDDTQVHTEYSSLRSIVVANYEESIKMPINEPAPGRKKSQIQEYVDYNGGAGVQHIALKTQDIITAIRHLRERGMEFLAVPSTYYKQLREKLKTAKIRVKESIDVLEELKILVDYDEKGYLLQIFTKPVQDRPTLFLEIIQRHNHQGFGAGNFNSLFKAFEEEQDLRGNLTDLETNGAAPGT

SEQ ID NO: 56 - protein, 391 aa, Otolemur garnettii
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKAREQGAKIVREPWVEQDKFGKVKFAVLQTYGDTTHTLVEKMNYTGRFLPGFEAPTFKDPLLSKLPKCSLEIIDHIVGNQPDQEMVPASEWYLKNLQFHRFWSVDDTQVHTEYSSLRSIVVANYEESIKMPINEPAPGRKKSQIQEYVDYNGGAGVQHIALKTEDIIMAIRHLRERGMEFLAVPSTYYRQLRENLKTAKIQVKESIDVLEELKILVDYDEKGYLLQIFTKPMQDRPTLFLEVIQRRNHQGFGAGNFNSLFKAFEEEQDLRGNLTDLEPNGVVS

SEQ ID NO: 57 - protein, 410 aa, Cavia porcellus
MPWPPGTVSWEARPRPAMTTYSDKGEKPERGRFLHFHSVTFWVGNAKQAAAFYCSKMGFEPLAYRGLETGSREVASHVIKQGQIVFVFSSPLNPGNKELGDHLVKHGDGVKDIAFEVEDCDYIVQKARERGAKVVREPWVEQDRFGKVKFAVLQTYGDTTHTLVEKTGYTGSFLPGFEAPRVKDSLLSKLPNCGLEIIDHVVGNQPDQEMLSASEWYLKNLQFHRFWSVDDTQVHTEYSSLRSIVVTNYEESIKMPINEPAPGRKKSQIQEYVDYNGGAGVQHIALKTQDIITAIRHLRERGAEFLAVPSTYYKQLRENLKSAKVQVKENIDMLEELRILVDYDEKGYLLQIFTKPMQDRPTLFLEVIQRHNHQGFGAGNFNALFKAFEAEQDLRGNLTDLEPNGVASGM

SEQ ID NO: 58 - protein, 393 aa, Myotis brandtii
MTSYSNKGEKPERGRFLHFHSVTFWVGNAKQAASFYCSKMGFKPIAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYTGFFLPGFEPTTNRDPVLSKLPQSNLEVIDHIVGNQPDQEMLSASARYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKESLDALEELKILVDYDENGYLLQIFTKPMQDRPTLFLEVIQRHNHQGFGAGNFNALFKAFEEEQNLRGNLTDLEPNGVIRGM

SEQ ID NO: 59 - protein, 393 aa, Equus asinus
MTTYSNKGEKPEKGRFLHFHSVTFWVGNAKQAASFYCNKLGFEPLAYKGLETGSREVVSYVIKQGKIIFVFSSALNPWNKEMGDHLVKHGDGVKDIAFEVEDCDYIVQKARERGAKIVREPWVEQDKFGKVKFAVLQTYGDTTHTLVEKMSYAGRFLPGFEAPAFRDPLLSKLPNCSLEIIDHVVGNQPDHEMESASEWYLKNLQFHRFWSVDDTQVHTEYSSLRSIVVANYEESIKMPINEPAPGRKKSQIQEYVDYNGGAGVQHIALKTHDIITAIRHLRERGMEFLAVPSSYYRQLQEKLKSAKIRVKESIDVLEELKILVDYDEKGYLLQIFTKPMQDRPTLFLEVIQRHNHQGFGAGNFNALFKAFEEEQDLRGNLTDMQTNILAPGK

SEQ ID NO: 60 - protein, 384 aa, Marmota marmota marmota
MTTYSDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYVVQKARERGAKIVREPWVEEDKFGKVKFAVLQTFGDTTHTLVEKTNYSGQFLPGFKAPLLKDSLLPKLPRCGLEIIDHVVGNLPDQEMLSASEWYLRNLQFHRFWSVDDTQVHTEYSSLRSIVVTNYEETIKMPINEPAMGMKKSSIQEYVDYNGGAGVQHVGLKTQDIITTIRNLQERGMEFLTVPSTYYKQLRENLKTAKIRVKESIDVLEELQILMDYDEKGYILQIFTKPMQDRPTLFLEVIQRHNHQGFGAGNFNSLFKALEDAQELRGNLTNL

SEQ ID NO: 61 - protein, 393 aa, Marmota marmota marmota
MTTYSDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYIVQKARERGAKIVQEPWVEEDKFGKVKFAVLQTYGDTTHTLVEKTNYTGRFLPGFEAPLLKDSLLPKLPKCGLEIIDHVVGNQPDQEMLSASEWYLRNLQFHRFWSVDDTQVHTEYSSLRSIVVTNYEETIKMPINEPAMGRKKSQIQEYVDYNGGAGVQHIALKTQDIITAIRSLRDRGLEFLSVPSTYYKQLRENLKTAKIRVKESIDVLEELKILVDYDEKGYLLQIFTKPMQDRPTLFLEVIQRHNHQGFGAGNFNSLFKAFEEEQAIRGNLTDLEIKGEVSGM

SEQ ID NO: 62 - protein, 393 aa, Cebus imitator
MTTYSDKGAKPERGRFLHFHSVTFWVGNAKQAASFYCNKMGFEPLAYRGLETGSREVVSHVIKQGKIVFVLSSALNPWNKEMGDHLVKHGDGVKDIAFEVEDCDYIVQKARERGAKIVREPWVEEDNFGKVKFAVLQTYGDTTHTLVEKMNYAGRFLPGYKAPAFMDPLLPQLPKCSLEVIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRGRGMEFLSVPSMYYKQLREKLKVAKIKVKESIDVLEELKILVDYDEKGYLLQIFTKPVQDRPTLFLEVIQRHNHQGFGAGNFNSLFKAFEEEQDLRGNLTNMETDGVVPGM

SEQ ID NO: 63 - protein, 393 aa, Capra hircus
MTTYSDKGEKPERGRFLHFHSVTFWVGNAKQAASYYCSKLGFEPLAYKGLETGSREVVSHVVKQGQIVFIFSSALNPWNKEMGDHLVKHGDGVKDIAFEVEDCDYIVQKARERGAKIVREPWVEQDKLGKVKFAVLQTYGDTTHTLVEKMNYTGRFLPGFEAPAFMDPQLSKLPNCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTKDIITAIRHLRERGVEFLAVPSTYYKQLREKLESAKIRVKENIDILEELKILVDYDEKGYLLQIFTKPMQDRPTLFLEVIQRHNHQGFGAGNFNSLFKAFEEEQDLRGNLTDMEPNGVVSSM

SEQ ID NO: 64 - protein, 393 aa, Panthera pardus
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLFLEVIQRHNHQGFGAGNFNSLFKAFEEEQNLRGNLTDLENNGIVPGM

SEQ ID NO: 65 - protein, 393 aa, Hipposideros armiger
MTSYSNKGEKPVRGRFLHFHSVTFWVGNAKQAASFYCNKMGFEPLAYKGLETGSREVVSHVIKQGEIVFVFSSALNPWHKEMGDHLVKHGDGVKDIAFEVEDCDYIVQKARERGAKIIREPWVEQDKFGKVKFAVLQTYGDTTHTLVEKMNYTGRFLPGFEAPVFKDPQLSKLPHCKLEVIDHIVGNQPDQEMVSASDWYLNNLQFHRFWSVDDTQVHTEYSSLRSIVVANYEESIKMPINEPAPGRKKSQIQEYVDYNGGAGVQHIALKTHDIITAIRHLRERGIEFLAVPSTYYKQLREKLKSAKIRVKENIDILEELKILVDYDEKGYLLQIFTKPMQDRPTLFLEVIQRHNHQGFGAGNFNSLFKAFEEEQNLRGNLTDMDTNGVIHGM

SEQ ID NO: 66 - protein, 393 aa, Crocodylus porosus
MTTYTDKGQKPERGRFLHFHSITFWVGNAKQAASYYCNKMGFEEMAYRGLETGSREVVSHVIRQDKIVFVLSSALNPGNEEMGAHLVKHGDGVKDVAFEVEDCDFIVQEARERGAAIVKEPWVEEDKHGRVKFAVIQTYGDTTHTLVEKLNYGGLFLPGFEAPLFKDQLLPKLPSTKLRFIDHVVGNQPDLEMVPVAEWYQRNLLFHRFWSVDDKQLHTEFSALRSIVVANYEETIKMPINEPAVGKKKSQIQEYIDYYGGPGVQHIALNTSDIISAITNLKQRGMEFMSVPATYYQQLRQRLKTAKIEVKESIDKLEELKILVDFDEKGYLLQIFTKPVQDRPTLFLEVIQRYNHQGFGAGNFKSLFEAIEADQDARGNLTLLTSNVENNFI

SEQ ID NO: 67 - protein, 393 aa, Ailuropoda melanoleuca
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGARIVREPWTEEDKFGKVKLAVLQTYGDTTHTLVEKMNYTGRFLPGFEAPASVDPLLSKLPSCSLEIIDHIVGNQPDQEMVSASEWYLKNLQFHRFWSVDDTQVHTEYSSLRSIVVANYEESIKMPINEPALGKKKSQIQEYVDYNGGAGVQHIALKTQDIITAIRHLRERGLEFLAVPSTYYKQLREKLKSAKIRVKESIDVLEELKILVDYDEKGYLLQIFTKPMQDRPTLFLEVIQRHNHQGFGAGNFNSLFKAFEEEQDLRGNLTDLETNGILRGM

SEQ ID NO: 68 - protein, 393 aa, Bos indicus
  misc_feature (155)..(155): Xaa can be any naturally occurring amino acid
  misc_feature (389)..(389): Xaa can be any naturally occurring amino acid
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGXFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRPTLFLEVIQRHNHQGFGAGNFNSLFKAFEEEQDLRGNLTDMEPNGXVSGM

SEQ ID NO: 69 - protein, 393 aa, Castor canadensis
MTTYSDKGQKPEKGRFLHFHSVTFWVGNAKQAASFYCSKMGFEPLAYKGLETGSREVVSHVIKQGKIVFVLSSALNPWNKEMGDHLVKHGDGVKDIAFEVEDCDYIVQKARERGAKIVQEPWVEQDKFGKVKFAVLQTYGDTTHTLVEKMNYTGRFLPGFEAPTFKDPLLSKLPNCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIIAAIRHLRERGMEFLAVPPTYYKQLRENLKLAKIQVKENIDVLEELKILVDYDEKGYLLQIFTKPMQDRPTLFLEVIQRHNHQGFGAGNFNSLFKAFEEEQALRGNLTDLEANGMVSGM

SEQ ID NO: 70 - protein, 393 aa, Sus scrofa
MTSYSDKGEKPERGRFLHFHSVTFWVGNAKQAASYYCSKIGFEPLAYKGLETGSREVVSHVVKQDKIVFVFSSALNPWNKEMGDHLVKHGDGVKDIAFEVEDCDYIVQKARERGAIIVREPWIEQDKFGKVKFAVLQTFGDTTHTLVEKMNYTGCFLPGFEAPTFTDPLLSKLPKCGLEIIDHIVGNQPDQEMESASQWYMRNLQFHRFWSVDDTQIHTEYSALRSVVMANYEESIKMPINEPAPGKKKSQIQEYVDYNGGAGVQHIALKTEDIITAIRSLRERGVEFLAVPFTYYKQLQEKLKSAKIRVKESIDVLEELKILVDYDEKGYLLQIFTKPMQDRPTVFLEVIQRNNHQGFGAGNFNSLFKAFEEEQELRGNLTDTDPNGVAFRL

SEQ ID NO: 71 - protein, 393 aa, Microcebus murinus
MTTYSNKGAKPERGRFLHFHSVTFWVGNAKQAAAFYCSKMGFEPLAYRGLETGSREVVSHVIKQGQIVFVLSSALNPWNKEMGDHLVKHGDGVKDIAFEVEDCDYIVQKARERGAKIVREPWVEQDKFGKVKFAVLQTYGDTTHTLVEKMGYTGRFLPGFEAPAFRDPLLPKLPNCTLEIIDHIVGNQPDQEMVPASEWYLKNLQFHRFWSVDDTQVHTEYSSLRSIVVANYEESIKMPINEPAPGKKKSQIQEYVDYNGGAGVQHIALKTQDIITAIRHLRERGTEFLAVPSTYYKQLREKLKTAKIRVKENIDVLEELKILVDYDEKGYLLQIFTKPVQDRPTLFLEVIQRHNHQGFGAGNFNSLFKAFEEEQALRGNLTDLETNGVVPGM

SEQ ID NO: 72 - protein, 393 aa, Odocoileus virginianus texanus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDVAFEVEDCDYIVQKARERGAKIVREPWLEQDKLGKVKFAVLQTYGDTTHTLVEKMNYTGRFLPGFEAPAFMDPQLSKLPNCSLEIIDHIVGNQPDQEMVSASEWYLKNLQFHRFWSVDDTQVHTEYSSLRSIVVANYEESIKMPINEPAPGKKKSQIQEYVDYNGGPGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNSLFKAFEEEQDLRGNLTDTEPNGVVSSM

SEQ ID NO: 73 - protein, 393 aa, Phascolarctos cinereus
MTSYTDRGEKPPRGRFLHFHSITFWVGNAKQAASFYCHKMGFSPLAYRGLETGSREVASHVVKQGKIIFIFSSALNPGNKEMGDHLVKHGDGVKDISFEVEDCDYIVQKARERGAIIVKEPWIEQDKFGWVKFAVLQTYGDTTHTLVEKLNYTGPFLPGFEAPFFEDPLLPTLPDCKLAMIDHVVGNQPDQEMVPIADWYKKTLMFHRFWSVDDKQVHTEFSSLRSIVMANYEETIRMPINEPAMGRKKSQIQEYVDYYGGAGVQHIAMSTTDIISAITHLRARGMEFLNVPSTYYKQLRERLKSAKIQVKENMDILEKLKILVDYDEKGYLLQIFTKPVQDRPTVFLEVIQRHNHQGFGAGNFNSLFKAFEEEQNIRGNLTDLAPDGLGTVM

SEQ ID NO: 74 - protein, 393 aa, Mus pahari
MTSYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRENLKSAKIQVKESMDVLEELKILVDYDEKGYLLQIFTKPMQDRPTLFLEVIQRHNHQGFGAGNFNSLFKAFEEEQALRGNLTDMETNGVRSGM

SEQ ID NO: 75 - protein, 393 aa, Mus caroli
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDVAFEVEDCDHIVQKARERGAKIVREPWVEQDKFGKVKFAVLQTYGDTTHTLVEKINYTGRFLPGFEAPIYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGIEFLAVPSSYYKLLRENLKSAKIQVKENMDILEELQILVDYDEKGYLLQIFTKPMQDRPTLFLEVIQRHNHQGFGAGNFNSLFKAFEEEQALRGNLTDLEPNGVRSGM

SEQ ID NO: 76 - protein, 393 aa, Mesocricetus auratus
MTTYNNKGPKPERGRFLHFHSVTFWVGNAKQAASFYCNKMGFEPLAYKGLETGSREVVSHAIKQGKIVFVLCSALNPWNKEMGDHLVKHGDGVKDIAFEVEDCDHIVQKARERGAKIVREPWVEEDKFGKVKFAVLQTYGDTTHTLVEKINYTGRFLPGFEAPTYKDTLLPKLPRCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRENLKTAKIQVKESLDVLEELKILVDYDEKGYLLQIFTKPMQDRPTLFLEVIQRHNHQGFGAGNFNSLFKAFEEEQALRGNLTDMETNGVRSGM

SEQ ID NO: 77 - protein, 393 aa, Meriones unguiculatus
MTTYSNRGPKPERGQFLHFHSVTFWVGNAKQAASFYCNKMGFEPLAYRGLETGSREVVSHVIKQGKIVFVLSSALNPWNKEMGDHLVKHGDGVKDIAFEVEDCEHIVQKARERGAKIVREPWVEEDKFGKVKFAVLQTYGDTTHTLVEKINYTGRFLPGFEAPAYKDILLSKLPNCHLEIIDHIVGNQPDQEMESASEWYLKNLQFHRFWSVDDTQVHTEYSSLRSIVVANYEESIKMPINEPAPGRKKSQIQEYVDYNGGAGVQHIALKTEDIITTIRHLRERGMEFLAVPSSYYKLLRENLKTAKIQVKESMNVLEELKILVDYDEKGYLLQIFTKPMQDRPTLFLEVIQRHNHQGFGAGNFNALFKAFEQEQALRGNLTDLETNGVRSGM

SEQ ID NO: 78 - protein, 393 aa, Enhydra lutris kenyoni
MTTYSDRGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYTGRFLPGFEAPASVDPLLSKLPTCSLEIIDHIVGNQPDQEMVSASEWYLKNLQFHRFWSVDDTQVHTEYSSLRSIVVTNYEESIKMPINEPAPGRKKSQIQEYVDYNGGAGVQHIALKTQDIITAIRHLRARGMEFLGVPSSYYKQLREKLKSAKIQVKESIDVLEELKILVDYDEKGYLLQIFTKPMQDRPTLFLEVIQRHNHQGFGAGNFNSLFKAFEEEQDLRGNLTDLETNGTLRCM

SEQ ID NO: 79 - protein, 393 aa, Delphinapterus leucas
MTTYSNKGEKPERGRFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIHRYNHQGFGAGNFNSLFKAFEEEQDLRGNLTDMETNGTVAGM

SEQ ID NO: 80 - protein, 394 aa, Loxodonta africana
MTTYSDKGVKPERGRFLHFHSVTFWVGNAKQAASFYCSKMGFKPLAYRGLETGSREVVSHVIKHGKIVFVLSSALNPWNKEMGDHLVKHGDGVKDIAFEVEDCNYIVQKARERGAKIVREPWVEQDKCGRVKFAVLQTYGDTTHTLVEKINYTGCFLPGFEAPTFMDPLLSKLPSCNLEIIDHIVGNQPDQEMASASEWYLKNLQFHRFWSVDDTQVHTEYSSLRSIVVTNYEESIKMPINEPAPGKKKSQIQEYVDYNGGAGVQHIALRTQDIITAIRHLKERGMEFLAVPSTYYKQLREKLKSAKVQVKESIDVLEELKILVDYDEKGYLLQIFTKPVQDRPTLFLEVIQRNNHQGFGAGNFNSLFKAFEEEQNLRGNLTDLESNQPGRARH

SEQ ID NO: 81 - protein, 393 aa, Octodon degus
MTTYSDKGAKPERGRFLHFHSVTFWVGNAKQAAAYYCSKMGFELLAYRGLETGSREVASHVIKQGQIVFVFSSPLNPWNKEMGDHLVKHGDGVKDIAFEVQDCDYIVQKARERGAKVVREPWVEQDKFGKVKFAVLQTYGDTTHTLVEKMSYTGSFLPGFEAPRVKDALLFKLPSCGLEIIDHIVGNQPDQEMASASEWYLRNLQFHRFWSVDDTQVHTEYSSLRSIVVTNYEESIKMPINEPAPGRKKSQIQEYVDYNGGAGVQHIALKTQDIITAIRHLRERGAEFLAVPSSYYRQLRENLKSAKVRVKESIDVLEELKILVDYDEKGYLLQIFTKPMQDRPTLFLEVIQRHNHQGFGAGNFNALFKAFEAEQDLRGNLTDLETNGEVSGM

SEQ ID NO: 82 - protein, 393 aa, Chrysemys picta bellii
MTTYTDKGEKPEGGKFLHFHSLTFWVGNAKQAASFYCNKMGFEELAYKGLETGSREVVSHVIKQDKIIFVLSSALNPENKDMGEHLVKHGDGVKDIAFEVEDCDFIVQKAKERGAVIVKEPWVEEDKYGKVKFAVIQTYGDTTHTLIENLNYKGLFLPGFEPPLFKDPLLPKLPSGKLSFIDHVVGNQPDLQMVPVAEWYQKNLLFHRFWSVDDKQLHTQFSALRSIVVANYEETIKMPINEPAVGKKKSQIQEYVEYYGGAGVQHIALNTPDIITAVTNLKQRGIEFMTVPSTYYQQLREKLKSAKIKVKENIDKLEELKILVDFDEKGYLLQIFTKPVQDRPTVFLEVIQRHNHQGFGAGNFKSLFQAIEDDQDARGNLTILTANGETNFI

SEQ ID NO: 83 - protein, 393 aa, Pongo abelii
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 84 - protein, 393 aa, Terrapene carolina triunguis
MTTYTDKGEKPEGGKFLHFHSLTFWVGNAKQAASFYCNKMGFEELAYKGLETGSREVVSHVIKQDKIIFVLSSALNPENKEMGEHLLKHGDGVKDIAFEVEDCDFIVQKAKERGAVIVKEPWVEEDKYGKVKFAVIQTYGDTTHTLIENLNYKGLFLPGFEPPLFKDPLLPKLPSGKLSFIDHVVGNQPDLQMVPVAEWYQKNLLFHRFWSVDDKQLHTQFSALRSIVVANYEETIKMPINEPAMGKKKSQIQEYVEYYGGAGVQHIALNTPDIITAVTNLKQRGMEFMTVPSTYYQQLREKLKSAKIKVKENIDKLEELKILVDFDEKGYLLQIFTKPVQDRPTVFLEVIQRHNHQGFGAGNFKSLFQAIEDDQDARGNLTILTANGETNFI

SEQ ID NO: 85 - protein, 393 aa, Neophocaena asiaeorientalis asiaeorientalis
MTTYSNKGEKPERGRFLHFHSVTFWVGNAKQAASYYCSKMGFESLAYKGLETGSREVVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDITTAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVAGM

SEQ ID NO: 86 - protein, 393 aa, Theropithecus gelada
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRQRGMEFLSVPSTYYKQLREKLKTAKIKVKENIEVLEELKILVDYDEKGYLLQIFTKPVQDRPTLFLEVIQRHNHQGFGAGNFNSLFKAFEEEQNLRGNLTDLETNGVVPGM

SEQ ID NO: 87 - protein, 393 aa, Callorhinus ursinus
MTTYSDKGRKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGWFLPGFETPASVDPLLSKLPTCSLEIIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDTLEELKILVDYDEKGYLLQIFTKPMQDRPTLFLEVIQRHNHQGFGAGNFNSLFKAFEEEQDLRGNLTDLKNTRTLPGT

SEQ ID NO: 88 - protein, 393 aa, Vulpes vulpes
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEEDKFGKVKLAVLQTYGDTTHTLVEKMNYTGRFLPGFEAPACVDPLLSKLPSCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRDRGMEFLAVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLETNGTMPGM

SEQ ID NO: 89 - protein, 384 aa, Urocitellus parryii
MTTYTDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYIVQKARERGAKVVREPWVEEDKFGKVKFAVLQTFGDTTHTLVEKTNYSGRFLPGFQAPLLKDSLLPKLPKCGLEIIDHVVGNLLDHEMLSASEWYLRNLQFHRFWSVDDTQVHTEYSSLRSIVVTNYEETIKMPINEPAMGMKKSSIQEYVDYNGGAGVQHVGLKTQDIITTIRNLQERGMEFLTVPSTYYKQLRENLKTAKIQVKESIDVLEELQILMDYDEKGYILQIFTRPMQDRPTLFLEVIQRHNHQGFGAGNFNSLFKALEDAQELRGNLTNL

SEQ ID NO: 90 - protein, 393 aa, Ursus arctos horribilis
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAMLQTYGDTTHTLVEKMNYTGRFLPGFEAPASVDPLLSKLPSCSLEIIDHIVGNQPDQEMVSASEWYLKNLQFHRFWSVDDTQVHTEYSSLRSIVVANYEESIKMPINEPALGKKKSQIQEYVDYNGGAGVQHIALKTQDIITAIRHLRERGLEFLAVPSTYYKQLREKLKSAKIRVKESIDVLEELKILVDYDEKGYLLQIFTKPMQDRPTLFLEVIQRHNHQGFGAGNFNSLFKAFEEEQDLRGNLTNLETNGILRGM

SEQ ID NO: 91 - protein, 393 aa, Acinonyx jubatus
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLAVPSTYYKQLREKLKSAKIRVKENIDVLEELKILVDYDEKGYLLQIFTKPVQDRPTLFLEVIQRHNHQGFGAGNFNSLFKAFEEEQNLRGNLTDFENNGIVPGM

SEQ ID NO: 92 - protein, 393 aa, Homo sapiens
MTTYSDKGAKPERGRFLHFHSVTFWVGNAKQATSFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 93 - protein, 461 aa, Gulo gulo
DDITLSTEAAARSEAPKPGSFQRWCRYHPSLGRPGSKGRDLFGVKYFCPALHWPLVPISEQEASPRSTMTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYTGRFLPGFEAPASVDPLLSKLPTCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRARGMEFLCVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLQTNGTLRGM

SEQ ID NO: 94 - protein, 393 aa, Bos indicus x Bos taurus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRPTLFLEVIQRHNHQGFGAGNFNSLFKAFEEEQDLRGNLTDMEPNGGVSGM

SEQ ID NO: 95 - protein, 393 aa, Tupaia chinensis
MTTYSDKGAKPQRGRFLHFHSVTFWVGNAKQAASFYCSKMGFEPLAYKGLETGSREVVSHVIRQGKIVFVLSSALNPWNKEMGDHLVKHGDGVKDIAFEVEDCDYIVQKARERGAKIVREPWVEKDKFGKVKFAVLQTYGDTTHTLVEKMNYTGRFLPGFEAPTYVDPHLAKLPDCNLEIIDHIVGNQPDQEMVSASEWYLRNLQFHRFWSVDDTQVHTEYSSLRSIVVANYEESIKMPINEPAPGKKKSQIQEYVDYNGGAGVQHIALKTHDIITAIRHLRERGMEFLAVPSTYYRQLREGLKSAKIQVKESIDALEELKILVDYDEKGYLLQIFTKPVQDRPTLFLEVIQRHNHQGFGAGNFNSLFKAFEEEQALRGNLTDLETNGVALGM

SEQ ID NO: 96 - protein, 393 aa, Vombatus ursinus
MTSYTDRGQKPPRGRFLHFHSITFWVGNAKQAASFYCHKMGFSPFAYRGLETGSRDVASHVVKQGKIIFIFSSALNPGNKEMGDHLVKHGDGVKDISFEVEDCDYIVQKARERGAIIVKEPWTEQDKFGWVKFAVLQTYGDTTHTLVEKLNYTGPFLPGFEAPLFEDPLLPTLPDCKLAMIDHVVGNQPDQEMVPAADWYKKNLMFHRFWSVDDKQVHTEFSSLRSIVMANYEETIKMPINEPAMGRKKSQIQEYVDYYGGAGVQHIAMSTPDIISAITYLRARGLEFLSVPSTYYKQLREGLKSAKIQVKESIDTLEELKILVDYDEKGYLLQIFTKPVQDRPTVFLEVIQRHNHQGFGAGNFNSLFKAFEEEQNIRGNLTDLAPNGLGIVM

SEQ ID NO: 97 - protein, 393 aa, Eptesicus fuscus
MTSYTNRGEKPERGRFLHFHSVTFWVGNAKQAASFYCSKMGFKPLAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYTGFFLPGFEPTTNRDPALSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKESLDALEELRILVDYDENGYLLQIFTKPMQDRPTLFLEVIQRHNHQGFGAGNFNALFKAFEEEQNLRGNLTDMETNGVVRGM

SEQ ID NO: 98 - protein, 392 aa, Sousa chinensis
SLAPSLLLQPERGRFLHFHSVTFWVGNAKQAASYYCSKMGFEPLAYKGLETGSRETVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVPGM

SEQ ID NO: 99 - protein, 393 aa, Platysternon megacephalum
MTTYTDKGEKPEGGKFLHFHSLTFWVGNAKQAASFYCNKMGFEELAYKGLETGSREVVSHVIKQDKIIFVLSSALNPENEEMGEHLVKHGDGVKDIAFEVEDCDFIVQKAKERGAVIVKEPWVEEDKYGKVKFAVIQTYGDTTHTLIENLNYKGLFLPGFEPPLFKDPLLPKLPSGKLSFIDHVVGNQLDLHMVPVAEWYQKNLLFHRFWSVDDKQLHTQFSSLRSIVVANYEETIKMPINEPAMGMKKSQIQEYVEYYGGAGVQHIALNTSDIITAVTNLKQRGMEFMVVPSTYYQQLREKLKSAKIKVKENIDKLEELKILVDFDGKGYLLQIFTKPVQDRPTVFLEVIQRHNHQGFGAGNFKSLFQAIEDDQDARGNLTILTANGETNSC

SEQ ID NO: 100 - protein, 393 aa, Grammomys surdaster
MTTYTNKGPKPERGRFLHFHSVTFWVGNAKQAASFYCNKMGFEPLAYRGLETGSREVVSHVIKQGKIVFVLCSALNPWNKEMGDHLAKHGDGVKDIAFEVEDCEYIVQKARERGAKIVREPWVEQDKFGKVKFAVLQTYGDTTHTLVEKVNYTGRFLPGFEAPTYKDNLLPKLPRCNLEIIDHIVGNQPDQEMESASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKMLRENLKRAKIQVKESLDVLEELKILVDYDEKGYLLQIFTKPMQDRPTLFLEVIQRHNHQGFGAGNFNALFKAFEEEQALRGNLTDLETNGVRSGM

SEQ ID NO: 101 - protein, 392 aa, Monodon monoceros
TTYSNKGEKPERGRFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIHRYNHQGFGAGNFNSLFKAFEEEQDLRGNLTDMETNGTVAGT

SEQ ID NO: 102 - protein, 393 aa, Monodon monoceros
MTTYSNKGEKPERGRFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIHRYNHQGFGAGNFNSLFKAFEEEQDLRGNLTDMETNGTAAGT

SEQ ID NO: 103 - protein, 393 aa, Suricata suricatta
MTTYSDKGEKPERGRFLHFHSVTFWVGNAKQAASFYCSKMGFEPLAYKGLETGSREVVSHAIKQGKIVFVFSSALNPWNKEIGDHLAKHGDGVKDIAFEVEDCDYIVQKAKERGAKVVREPWIEQDKFGKVKLAVLQTYGDTTHTLVEKMNYTGLFLPGFEAPVFLDPLLSKLPSCSLEIIDHIVGNQPDQEMVSAAEWYLKNLQFHRFWSVDDTQVHTEYSSLRSIVVANYEENIKMPINEPAPGKKKSQIQEYVDYNGGPGVQHIALKTQDIITAIRHLRERGMEFLGVPSTYYKQLRERLKSAKIRVKENIDVLEELKILVDYDEKGYLLQIFTKPMQDRPTLFLEVIQRHNHQGFGAGNFNSLFKAFEEEQNLRGNLTDLETNGVVPGM

SEQ ID NO: 104 - protein, 393 aa, Lynx canadensis
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPTFVDPLLSKLPSCSLEIIDHIVGNQPDQEMESASDWYLKNLQFHRFWSVDDTQVHTEYSSLRSIVVANYEESIKMPINEPALGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLFLEVIQRHNHQGFGAGNFNSLFKAFEEEQNLRGNLTDLENNGIVPGM

SEQ ID NO: 105 - protein, 384 aa, Marmota monax
MTTYSDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYIVQKAREQGAKIVREPWVEEDKFGKVKFAVLQTFGDTTHTLVEKTNYSGRFLPGFKAPLLKDSLLPKLPRCGLEIIDHVVGNLLDHEMSSASEWYLRNLQFHRFWSVDDTQVHTEYSSLRSIVVTNYEETIKMPINEPAMGMKKSSIQEYVDYNGGAGVQHVGLKTQDIITTIRNLQERGMEFLTVPSTYYKQLRENLKTAKIRVKESIDVLEELQILMDYDEKGYILQIFTKPMQDRPTLFLEVIQRHNHQGFGAGNFNSLFKALEDAQELRGNLTNL

SEQ ID NO: 106 - protein, 393 aa, Nomascus leucogenys
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWIEQDKFGKVKFAVLQTYGDTTHTLVEKMNYIGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYRQLREQLKTAKIKVKENIDVLEELKILVDYDEKGYLLQIFTKPVQDRPTLFLEVIQRHNHQGFGAGNFNSLFKAFEEEQNLRGNLTNMETSGVVPGM

SEQ ID NO: 107 - protein, 394 aa, Rhinopithecus roxellana
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGMQ

SEQ ID NO: 108 - protein, 393 aa, Muntiacus muntjak
MTTYSDKGEKPESGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKFGKVKFAVLQTYGDTTHTLVEKMNYTGRFLPGFEAPAFMDPQLSKLPNCSLEIIDHIVGNQPDQEMVSASEWYLKNLQFHRFWSVDDTQVHTEYSSLRSIVVANYEESIKMPINEPAPGKKKSQIQEYVDYNGGPGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNALFKAFEEEQDLRGNLTDMEPNGVVPGM

SEQ ID NO: 109 - protein, 393 aa, Mastomys coucha
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCEHIVQKARERGAKIVREPWVEQDKFGKVKFAVLQTYGDTTHTLVEKIDYTGRFLPGFEAPIYKDTLLPKLPRCNLEIIDHIVGNQPDQEMESASEWYLKNLQFHRFWSVDDTQVHTEYSSLRSIVVANYEESIKMPINEPAPGRKKSQIQEYVDYNGGAGVQHIALKTEDIITTIRHLRERGMEFLAVPSSYYKLLRENLKTAKIQVKESMDVLEELKILVDYDEKGYLLQIFTKPVQDRPTLFLEVIQRHNHQGFGAGNFNSLFKAFEEEQALRGNLTDLETNGVRSGM

SEQ ID NO: 110 - protein, 387 aa, Camelus dromedarius
MTTYSDKGEKPERGRFLHFHSVTFWVGNAKQAASYYCSKMGFEPLAYKGLETRSRDVVSHVIKQGKIVFVFSSALNPWNKEMGDHLVKHGDGVKDIAFEVEDCDYIVQKARERGAKIVREPWVEQDKFGKVKFAVLQTYGDTTHTLVEKMNYTGRFLPGFEAPASTDPLLSKLPNCCLEIIDHIVGNQPDQEMLSASEWYLKNLQFHRFWSVDDTQVHTEYSSLRSIVVANYEESIKMPINEPAPGRKKSQIQEYVDYNGGAGVQHIALNTQDIITAIRHLRERGMEFLAVPSTYYKQLREKLKSAKIRVKENIDVLEELKILVDYDEKGYLLQIFTKPMQDRPTLFLEVIQRHNHQGFGAGNFNSLFKAFEEEQDLRGNLTDMETS

SEQ ID NO: 111 - protein, 393 aa, Papio anubis
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRQRGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 112 - protein, 393 aa, Sarcophilus harrisii
MTTYTDRGEKPPRGRFLHFHSITFWVGNAKQAASFYCNKMGFSPLAYRGLETGSREVASHVVKQGKIIFIFSSPLNPGNKEMGDHLVKHGDGVKDISFEVEDCDYIVQKARERGAVIVKEPWIEQDKFGRVKFAILQTYGDTTHTLVEKLNYTGPFLPGFETPRFLDPLLPKLPDCKLAMIDHVVGNQPDQEMVTAAEWYKKNLLFHRFWSVDDKQVHTEFSSLRSIVMANYEETIKMPINEPAMGRKKSQIQEYVDYYGGAGVQHIAMSTPDIISAITHLKARGMEFLSAPATYYKQLREGLKAAKMQVKENIDKLEELKILVDYDEKGYLLQIFTKPVQDRPTVFLEVIQRHNHQGFGAGNFNALFKAFEEEQSVRGNLTDLAPNGVGIAM

SEQ ID NO: 113 - protein, 393 aa, Crocuta crocuta
SSLSSSLLLQPERGRFLHFHSVTFWVGNAKQAASFYCNKMGFEPLAYKGLETGSREVVSHVIKQGKIVFVFSSALNPWDKEMGDHLVKHGDGVKDIAFEVEDCDYIVQKAKERGAKIVREPWIEQDKFGKVKLAVLQTYGDTTHTLVEKMNYTGRFLPGFEAPVFIDPILSKLPSCSLEIIDHIVGNQPDQEMVSASEWYLKNLQFHRFWSVDDTQVHTEYSSLRSIVVANYEESIKMPINEPALGKKKSQIQEYVDYNGGPGVQHIALKTQDIITAIRHLRERGMEFLGVPSTYYKQLREKLKSAKIRVKENIDVLEELKILVDYDEKGYLLQIFTKPMQDRPTLFLEVIQRHNHQGFGAGNFNSLFKAFEEEQNLRGNLTDLETNGTVRGM

SEQ ID NO: 114 - protein, 393 aa, Hylobates moloch
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYRQLREQLKTAKIKVKENIDVLEELKILVDYDEKGYLLQIFTKPVQDRPTLFLEVIQRHNHQGFGAGNFNSLFKAFEEEQNLRGNLTNMETSGVVPGM

SEQ ID NO: 115 - protein, 393 aa, Sapajus apella
MTTYSDKGAKPERGRFLHFHSVTFWVGNAKQAASFYCNKMGFEPLAYRGLETGSREVVSHVIKQGKIVFVLSSALNPWNKEMGDHLVKHGDGVKDIAFEVEDCDYIVQKARERGAKIVREPWVEEDKFGKVKFAVLQTYGDTTHTLVEKMNYAGRFLPGYKAPAFMDPLLPQLPKCSLEVIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRGRGMEFLSVPSTYYKQLREKLKVAKIKVKESIDVLEELKILVDYDEKGYLLQIFTKPVQDRPTLFLEVIQRHNHQGFGAGNFNSLFKAFEEEQDLRGNLTNMETDGVVPGM

SEQ ID NO: 116 - protein, 393 aa, Mustela erminea
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYLVQKAREQGAKIVREPWIEQDKFGKVKLAVLQTYGDTTHTLVEKMNYTGRFLPGFEAPVSVDPLLSKLPTCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLKARGMEFLGVPSSYYRQLREKLKTAKIQVKENIDVLEELKILVDYDEKGYLLQIFTKPMQDRPTLFLEVIQRHNHQGFGAGNFNALFKAFEEEQDLRGNLTNLETNSSLRGM

SEQ ID NO: 117 - protein, 387 aa, Camelus ferus
MTTYSDKGEKPERGRFLHFHSVTFWVGNAKQAASYYCSKMGFEPLAYKGLETRSRDVVSHVIKQGKIVFVFSSALNPWNKEMGDHLVKHGDGVKDIAFEVEDCDYIVQKARERGAKIVREPWVEQDKFGKVKFAVLHTYGDTTHTLVEKMNYTGRFLPGFEAPASTDPLLSKLPNCCLEIIDHIVGNQPDQEMLSASEWYLKNLQFHRFWSVDDTQVHTEYSSLRSIVVANYEESIKMPINEPAPGRKKSQIQEYVDYNGGAGVQHIALNTQDIITAIRHLRERGMEFLAVPSTYYKQLREKLKSAKIRVKENIDVLEELKILVDYDEKGYLLQIFTKPMQDRPTLFLEVIQRHNHQGFGAGNFNSLFKAFEEEQDLRGNLTDMETS

SEQ ID NO: 118 - protein, 393 aa, Phocoena sinus
MTTYSNKGEKPERGRFLHFHSVTFWVGNAKQAASYYCSKMGFESLAYKGLETGSREMVSHVIKQGKIVFIFSSALNPWNKEMGDHLVKHGDGVKDIAFEVEDCDYIAQKARERGAKIVREPWVEQDKFGKVKFAVLQTYGDTTHTLVEKMNYTGWFLPGFEVPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVAGM

SEQ ID NO: 119 - protein, 393 aa, Lontra canadensis
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYTGRFLPGFEAPASVDPLLSKLPTCSLEIIDHIVGNQPDQEMVSASEWYLKNLQFHRFWSVDDTQVHTEYSSLRSIVVANYEESIKMPINEPAPGRKKSQIQEYVDYNGGAGVQHIALKTQDIITAIRHLRARGMEFLCVPSSYYKQLREKLKSAKIQVKESIDVLEELKILVDYDEKGYLLQIFTKPMQDRPTLFLEVIQRHNHQGFGAGNFNSLFKAFEEEQDLRGNLTDLETNGTLRGM

SEQ ID NO: 120 - protein, 393 aa, Tyto alba
MTTYTDKGEKPLRGRFIHFHSITFWVGNAKQAASYYCNKMGFEELAYRGLETGSREVVSHVIKQDKIVFVLSSALNPGNEEMGEHLVKHGDGVKDIAFEVEDCDFIVQKAKERGAVVVKEPWVEEDKFGKVKFAVIQTYGDTTHTLIEKLNYKGLFLPGYHPPLFKDPLLPKLPSAKLNFVDHVVGNQPDLQMVPVADWYQKNLLFHRFWSVDDKQLHTEFSALRSIVVTNYEETIKMPINEPAFGKKKSQIQEYVDYYGGAGVQHIALNTSDIISAITNLKQRGMQFMDVPSSYYQMLRERLKTAKIKVKENIDKLAELKILVDFDEKGYLLQIFTKPVQDRPTVFLEVIQRHNHQGFGAGNFKSLFEAIEIDQDARGNLTILEPNGETKRI

SEQ ID NO: 121 - protein, 394 aa, Trachypithecus francoisi
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDLTFEVEDCDYIVQKARERGAKIVREPWVEQDKFGKVKFAVLQTYGDTTHTLVEKMNYTGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGMQ

SEQ ID NO: 122 - protein, 392 aa, Mirounga leonina
TTYSDKGKKPQRGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGRFLPGFETPASVDPLLSKLPSCSLEMVDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDTLEELKILVDYDEKGYLLQIFTKPMQDRPTLFLEVIQRHNHQGFGAGNFNSLFKAFEEEQDLRGNLTDSENTRTLPGM

SEQ ID NO: 123 - protein, 393 aa, Arvicanthis niloticus
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCEHIVQKARERGAKIIREPWVEEDKFGKVKFAVLQTYGDTTHTLVEKINYTGRFLPGFEAPTYKDNLLPKLSRCKLEVIDHIVGNQPDQEMESASEWYLKNLQFHRFWSVDDTQVHTEYSSLRSIVVANYEESIKMPINEPAPGRKKSQIQEYVDYNGGAGVQHIALKTEDIITTIRHLRERGMEFLAVPSSYYKMLRENLKIAKIQVKESMDVLEELKILVDYDEKGYLLQIFTKPMQDRPTLFLEVIQRHNHQGFGAGNFNALFKAFEEEQALRGNLTDLETNGVRSGM

SEQ ID NO: 124 - protein, 393 aa, Trachemys scripta elegans
MTTYTDKGEKPEGGKFLHFHSLTFWVGNAKQAASFYCNKMGFEELAYKGLETGSREVVSHVIKQDKIIFVLSSALNPENKEMGEHLVKHGDGVKDIAFEVEDCDFIVQKAKERGAVIVKEPWVEEDKYGKVKFAVIQTYGDTTHTLIENLNYKGLFLPGFELPLFKDPLLPKLPSGKLSFIDHVVGNQPDLQMVPVAEWYQKNLLFHRFWSVDDKQLHTQFSALRSIVVANYEETIKMPINEPAVGKKKSQIQEYVEYYGGAGVQHIALNTPDIITAVTNLKQRGMEFMTVPSTYYQQLREKLKSAKIKVKENIDKLEELKILVDFDEKGYLLQIFTKPVQDRPTVFLEVIQRHNHQGFGAGNFKSLFQAIEDDQDARGNLTILTANGETNFI

SEQ ID NO: 125 - protein, 393 aa, Pan paniscus
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCRLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 126 - protein, 393 aa, Callithrix jacchus
MTTYSDKGAKPERGRFLHFHSVTFWVGNAKQAASFYCTKMGFEPLAYRGLETGSREVVSHVIKQGKIVFVLSSALNPWNKEMGDHLVKHGDGVKDITFEVEDCDYIVQKARERGAKIVQEPWVEEDKFGKVKFAVLQTFGDITHTLVEKMSYAGRFLPGYEAPVFMDPLLPQLPKCSLKVIDHIVGNQPDQEMASASEWYLKNLQFHRFWSVDDTQVHTEYSSLRSIVVANYEESIKMPINEPAPGKKKSQIQEYVEYNGGAGVQHIALKTQDIITAIRHLRERGLEFLSVPSTYYKQLREKLKVAKIKVKESIDVLEELKILVDFDEKGYLLQIFTKPVQDRPTLFLEVIQRHNHQGFGAGNFNSLFKAIEEEQNLRGNLTNRETDGVVPGM

SEQ ID NO: 127 - protein, 393 aa, Canis lupus dingo
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEEDKFGKVKLAVLQTYGDTTHTLVEKINYTGRFLPGFEAPACVDPLLSKLPSCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRDRGMEFLAVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLETNGMMPGM

SEQ ID NO: 128 - protein, 430 aa, Rhinolophus ferrumequinum
MEFLGAAAELEMGSCPGALSTPASCPVFQAGSLTKINMTTYSDKGQKPERGRFLHFHSVTFWVGNAKQAASFYCSKMGFEPLAYKGLETGSREVVSHVVKQGEIVFVFCSALNPWNKEMGDHLVKHGDGVKDIAFEVEDCEYIVQKARERGAKIIREPWVEQDKFGKVKFAVLQTYGDTTHTLVEKMNYTGRFLPGFEAPTFTDPLLSKLPHCKLEIIDHIVGNQPDQEMTSASDWYLKNLQFHRFWSVDDTQVHTEYSSLRSIVVANYEESIKMPINEPAPGRKKSQIQEYVDYNGGAGVQHIALKTQDIITAIRRLRERGMEFLAVPSTYYKQLREKLKTAKIRVKENIDVLEELKILVDYDEKGYLLQIFTKPMQDRPTLFLEVIQRHNHQGFGAGNFNSLFKAFEEEQNLRGNLTDMETNGVITGM

SEQ ID NO: 129 - protein, 393 aa, Rhinolophus ferrumequinum
MTTYSDKGQKPERGRFLHFHSVTFWVGNAKQAASFYCSKMGFEPLAYKGLETGSREVVSHVVKQGEIVFVFCSALNPWNKEMGDHLVKHGDGVKDIAFEVEDCEYIVQKARERGAKIIREPWVEQDKFGKVKFAVLQTYGDTTHTLVEKMNYTGRFLPGFEAPAFTDPLLSKLPHCKLEIIDHIVGNQPDQEMTSASDWYLKNLQFHRFWSVDDTQVHTEYSSLRSIVVANYEESIKMPINEPAPGRKKSQIQEYVDYNGGAGVQHIALKTQDIITAIRRLRERGMEFLAVPSTYYKQLREKLKTAKIRVKENIDVLEELKILVDYDEKGYLLQIFTKPMQDRPTLFLEVIQRHNHQGFGAGNFNSLFKAFEEEQNLRGNLTDMETNGVITGM

SEQ ID NO: 130 - protein, 393 aa, Phyllostomus discolor
MTSYSDKGQKPERGRFLHFHSVTFWVGNAKQAASFYCSKVGFEPLAYKGLETGSREVVSHVVKQGQIVFVFSSALNPWNKEMGDHLVKHGDGVKDIAFEVEDCDYIVQKARERGAKIIREPWVEQDKFGKVKLAVLQTYGDTTHTLVEKMNYTGCFLPGFEAVDCKDPLLSKLPQCGLEVVDHIVGNQPDQEMQSASEWYLKNLQFHRFWSVDDTQVHTEYSSLRSIVVANYEESIKMPINEPAPGRKKSQIQEYVDYNGGAGVQHIALKTGDIISAIRHLRERGMEFLHVPSTYYKQLREKLKSAKIRVKENLDVLEELRILVDYDEKGYLLQIFTKPMQDRPTLFLEVIQRHNHQGFGAGNFNALFKAFEEEQALRGNLTDMEINGIARGM

SEQ ID NO: 131 - protein, 393 aa, Halichoerus grypus
MTTYSDKGKKPQRGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGRFLPGFETPASVDPLLSKLPSCSLEMIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDTLEELKILVDYDEKGYLLQIFTKPMQDRPTLFLEVIQRHNHQGFGAGNFNSLFKAFEEEQDLRGNLTDLENTRTLPGM

SEQ ID NO: 132 - protein, 393 aa, Onychomys torridus
MTSYTNKGPKPERGRFLHFHSVTFWVGNAKQAASFYCNKMGFEPLAYKGLETGSREVVSHVIKQGKIVFVLCSALNPWNKEMGDHLVKHGDAVKDIAFEVEDCEHIVQKARERGAKIVREPWVEQDKFGKVKFAVLQTYGDTTHTLVEKINYTGRFLPGFEAPTHKDTLLSKLPSCNLEVIDHIVGNQPDQEMTSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRGNLKTAKIQVKESMDVLEELKILVDYDEKGYLLQIFTKPMQDRPTLFLEVIQRHNHQGFGAGNFNSLFKAFEEEQALRGNLTDLETNGVRSGM

SEQ ID NO: 133 - protein, 393 aa, Rousettus aegyptiacus
MTSYSDKGKKPERGRFLHFHSVTFWVGNAKQAASFYCSKMGFEPLAYRGLETGSREVASHVIKQGQIVFVFSSALNPWNKEMGDHLVRHGDGVKDVAFEVQDCDSIVQKAQERGAKIIREPWVEQDKFGKVKFAVLQTFGDTTHTLVEKMNYRGPFLPGFMARAPRDSLLSKLPQCNLEVIDHVVGNQPDQEMLSASEWYLNNLQFHRFWSVDDKELHTEYSSLRSIVVTNYEESIKIPINEPAPGRKKSQIQEYVDYYGGAGVQHIALKTQDIITTIRSLKERGMEFLNTPPTYYKQLREKLKSAKIRVQENMDTLEELKILVDYDENGYLLQIFSKPMQDRPTLFLEVIQRHNHQGFGAGNFNSLFKALEEEQNLRGNLTDLETNGVVPGM

SEQ ID NO: 134 - protein, 393 aa, Molossus molossus
MTSYSNKGEKPERGRFLHFHSVTFWVGNAKQAASFYCSKMGFKPLAYRGLETGSRDVVSHVVKQGQIVFVFSSALNPWNKDMGDHLVKHGDGVKDIAFEVEDCDYIVQKARERGAKIIREPWVEQDKFGKVKFAVLQTYGDTTHTLVEKMKYTGFFLPGFEPVAKMDPALSKLPQCNLEVIDHIVGNQPDQEMESASDWYLNNLQFHRFWSVDDTQVHTEYSSLRSIVVANYEESIKMPINEPAPGRKKSQIQEYVEYNGGAGVQHIALKTQDIITAIRHLRERGMEFLDVPSTYYKQLREKLKSAKIRVKENIEILEELRILVDYDEKGYLLQIFTKPMQDRPTLFLEVIQRHNHQGFGAGNFNALFKAFEEEQNLRGNLTDMEPNGVLRGM

SEQ ID NO: 135 - protein, 393 aa, Myotis myotis
MTSYSNKGEKPERGRFLHFHSVTFWVGNAKQAASFYCSKMGFKPIAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYTGFFLPGFEPTTNRDPALSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKENLDALEELKILVDYDENGYLLQIFTKPMQDRPTLFLEVIQRHNHQGFGAGNFNALFKAFEEEQNMRGNLTDLEPNGVIRGM

SEQ ID NO: 136 - protein, 393 aa, Pipistrellus kuhlii
MTSYTNKGEKPERGRFLHFHSVTFWVGNAKQAASYYCSKMGFKPLAYRGLETGSREVVSHVVKQGQIVFIFSSALNPWNKEMGDHLVKHGDGVKDIAFEVEDCDYIVQKARQRGAKIIREPWVEQDKFGKVKFAVLQTYGDTTHTLVEKMDYTGLFLPGFNPTTHTDSVLSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPATYYRQLREKLKSAKIRVKESLDTLEELKILVDYDENGYLLQIFTKPMQDRPTLFLEVIQRHNHQGFGAGNFNALFKAFEEEQNLRGNLTDMETNGVVRGM

SEQ ID NO: 137 - protein, 393 aa, Balaenoptera musculus
MTTYSNKGQKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLKIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIHHLRERGMEFLAVPSTYYKQLREKLKTAKIRVKENIDVLEELKILVDYDEKGYLLQIFTKPMQDRPTLFLEVIQRYNHQGFGAGNFNSLFKAFEEEQDLRGNLTDMETNGLAPGM

SEQ ID NO: 138 - protein, 393 aa, Manis pentadactyla
MTTYSNQGEKPERGRFLHFHSVTFWVGNAKQAASFYCSKMGFEPLAYKGLETGSREVVSHVIKQGKIVFVFSSALNPWNREMGDHLVKHGDGVKDIAFEVEDCDYIVQKARERGAKIVQEPWVEQDKFGKVKFAVLQTYGDTTHTLVEKMNYSGCFLPGFEPLVFTDPLLSKLPKCYLEIIDHIVGNQPDQEMVSASEWYLKNLQFHRFWSVDDTQVHTEYSSLRSIVVANYEESIKMPINEPAPGRKKSQIQEYVDYNGGAGVQHIALKTQDIITAIRHLRERGLEFLAVPPTYYKQLREKLKSAKIRVKESIDTLEELKVLVDYDEKGYLLQIFTKPVQDRPTLFLEVIQRHNHQGFGAGNFNSLFKAFEEEQDLRGNLTDMEANGSMPGR

SEQ ID NO: 139 - protein, 393 aa, Manis javanica
MTTYSNQGEKPERGRFLHFHSVTFWVGNAKQAASFYCSKMGFEPLAYKGLETGSREVVSHVIKQGKIVFVFSSALNPWNREMGNHLVKHGDGVKDIAFEVEDCDYIVQKARERGAKIVQEPWVEQDKFGKVKFAVLQTYGDTTHTLVEKMNYSGCFLPGFEPLVLTDPLLSKLPKCYLEIIDHIVGNQPDQEMVSASEWYLKNLQFHRFWSVDDTQVHTEYSSLRSIVVANYEESIKMPINEPAPGRKKSQIQEYVDYNGGAGVQHIALKTQDIITAIRHLRERGLEFLAVPPTYYKQLRQKLKSAKIRVKESIDTLEELKVLVDYDEKGYLLQIFTKPVQDRPTLFLEVIQRHNHQGFGAGNFNSLFKAFEEEQDLRGNLTDMEANGSMPGK

SEQ ID NO: 140 - protein, 393 aa, Sturnira hondurensis
MTSYSNKGPKPERGRFVHFHSVTFWVGNAKQAASFYCTRMGFEPLAYRGLETGSREVVSHVVKQGQIVFVFSSALNPWNKEMGDHLVKHGDGVKDVAFEVEDCDYIVQKAQERGAKIIREPWVEQDKFGKVKFAVLQTYGDTTHTLVEKMSYTGCFLPGFKGLDSKDALLSKLPHCCLEVIDHIVGNQPDQEMQSASEWYLKNLQFHRFWSVDDTQVHTEYSSLRSIVVTNYEESIKMPINEPAPGKKKSQIQEYVDFNGGAGVQHIALKTQDIISAIRHLRERGMEFLHVPSTYYKQLREKLKSAKIRVKENMDVLEELNILVDYDDKGYLLQIFTKPMQDRPTLFLEIIQRHNHQGFGAGNFNALFEAIEEEQALRGNLTDLETNGVVQGK

SEQ ID NO: 141 - protein, 393 aa, Talpa occidentalis
MTTYSDKGAKPERGRFLHFHSVTFWVGNAKQAASFYCSKMGFEPLAYRGLETGSREVVSHVVKQGKIVFVLSSALNPWNKEMGDHLVKHGDGVKDIAFEVEDCDYIVQKARERGAKIVREPWVEEDKFGKVKFAVLQTYGDTTHTLVEKMNYTGRFLPGFEAPTFMDPLLSKLPSCTLEIIDHIVGNQPDQEMLSASDWYLKNLQFHRFWSVDDTQVHTEYSSLRSIVVANYEESIKMPINEPAPGKKKSQIQEYVDYNGGAGVQHIALKTQDIIKAIRHLRERGMEFLAVPSAYYRQLRENLKTAKIRVKESIDVLEELKILVDYDEKGYLLQIFTKPMQDRPTLFLEVIQRHNHQGFGAGNFNSLFKAFEEEQDLRGNLTDVETNGLVRGM

SEQ ID NO: 142 - protein, 390 aa, Choloepus didactylus
MTTYSNKGVKPERGQFLHFHSVTFWVGNAKQAASFYCNKMGFEPFAYKGLETGSREVVSHVIKQGKIVFVFSSALNPWNKEMGDHLVKHGDGVKDIAFEVEDCDYIVQKARERGAKIVRESWVEQDKFGKVKFAVLQTYGDTTHTLVEKMGYTGRFLPGFEAPAIKDPLLAKLPSCSLEVIDHIVGNQPDQEMVPVSDWYVKNLQFHRFWSVDDTQVHTEYSSLRSIVVANYEETIKMPINEPAQGRKKSQIQEYVDYNGGAGVQHIALKTQDITTTIRHLRERGLEFLAVPSTYYKQLREKLKTAKIRVKENIDVLEELKILVDYDEKGYLLQIFTKPVQDRPTLFLEVIQRHNHQGFGAGNFNSLFKAFEDEQNRRGNLTDLGTNGVP

SEQ ID NO: 143 - protein, 412 aa, Chlorocebus sabaeus
MCRQQSFFPGGSLHLRQQGQQAEGGQGLSSGSPPGWPLDPHEPCCNPVIQAVSFYCSKMGFEPLAYRGLETGSREVVSHVIKQGKIVFVLSSALNPWNKEMGDHLAKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLSDLETNGVVPGM

SEQ ID NO: 144 - protein, 393 aa, Chlorocebus sabaeus
MTTYSDKGAKPERGRFLHFHSVTFWVGNAKQAVSFYCSKMGFEPLAYRGLETGSREVVSHVIKQGKIVFVLSSALNPWNKEMGDHLAKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLSDLETNGVVPGM

SEQ ID NO: 145 - protein, 393 aa, Arvicola amphibius
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCEHIVQKARERGAKIVREPWVEQDKFGKVKFAVLQTYGDTTHTLVEKINYTGRFLPGFEAPVYKDTLLPKLPRCNLEVIDHIVGNQPDQEMVSASEWYLKNLQFHRFWSVDDTQVHTEYSSLRSIVVANYEESIKMPINEPAPGKKKSQIQEYVDYNGGAGVQHIALKTDDIITAIRHLRERGMEFLAVPSSYYKLLRENLKTAKIQVKESLDVLEELKILVDYDEKGYLLQIFTKPMQDRPTLFLEVIQRHNHQGFGAGNFNSLFKAFEEEQALRGNLTDLETNGVRSGM

SEQ ID NO: 146 - protein, 393 aa, Tachyglossus aculeatus
MTTYTDKGEKPLRGQFLHFHSVTFWVGNAKQAASFYCNKMGFEPLAYRGLETGSREVVSHVIKQDKIIFIFSSALNPGNKEMGEHLVKHGDGVKDVAFQVEDCDFIVQKARERGAAIVKEPWVEQDKNGRVKFAVLQTYGDTTHTLIEKIDYKGPFLPGYEAPLFLDPLLPKLPACKLNFIDHVVGNQPDHEMVPAVEWYQKNLLFHRFWSVDDKQVHTDFSALRSIVVANYEETIKMPINEPALGKKKSQIQEYVEYYGGAGVQHIALNTQDIISAIAHLKERGTEFMSVPSTYYTQLREKLKTAKIRVKENIKQLEELKILVDYDEKGYLLQIFTKPMQDRPTLFLEVIQRHNHQGFGAGNFTSLFKAIEEDQQARGNLTVLSPNGEVSAM

SEQ ID NO: 147 - protein, 393 aa, Canis lupus familiaris
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIMREPWIEEDKFGKVKLAVLQTYGDTTHTLVEKINYTGRFLPGFEAPACVDPLLSKLPSCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRDRGMEFLAVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLETNGMMPGM

SEQ ID NO: 148 - protein, 393 aa, Eschrichtius robustus
MTTYSNKGQKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLEIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIHHLRERGMEFLAVPSTYYKQLREKLKTAKIRVKENIDVLEELKILVDYDEKGYLLQIFTKPMQDRPTLFLEVIQRYNHQGFGAGNFNSLFKAFEEEQDLRGNLTDMETNGLAPGM

SEQ ID NO: 149 - DNA, 1179 bp, Rattus norvegicus
atgaccacctactctaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 150 - DNA, 1131 bp, Rattus norvegicus
atgtactgggacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 151 - DNA, 1062 bp, Rattus norvegicus
atgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaagatacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccaccatcttactacagattgttgagagaaaacttgaagtctgctaagatccaagttaaggaagacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 152 - DNA, 1182 bp, Yarrowia lipolytica
atgtctccatctgttgaagttaccccagctcacaccccaacctcttacgaagttaccaactctttggactcttacagaggttacgaccacgttcactggtacgttggtaacgctaagcaagctgcttctttctacatcaccagaatgggtttctctccaatcgcttacaagggtttggaaaccggttctagagacgttaccacccacgttgttggtaacggtcaagttagattcgctttctcttctgctttgagaaccggtgaaccacaagctgacgaaatccacgctcacttggttaagcacggtgacgctgttaaggacgttgctttcgaagttgacaacgttgaacaattgttctctgctgctgttaagaagggtgttagagttatctctgaaccaaaggttttgaaggacgctcacggttctgttacctacgctgttatctctacctacggtgacaccacccacaccttgatcgaaagaggttcttacgaaggtgctttcttgccaggtttcgttgacacctctgctaacaaggacccaatcgctgctttcttgccaaacatcgaattgatgcacatcgaccactgtgttggtaaccaagactggaacgaaatggacaacgcttgtaagtactacgaagaaaccttgggtttccacagattctggtctgttgacgacaaggacatctgtaccgaattctctgctttgaagtctgttgttatggcttctccaaacgaaaagatcaagatgccagttaacgaaccagctgttggtaagaagaagtctcaaatcgaagaatacatcgacttctacgacggtccaggtatccaacacatcgctttgagaaccgactgtatcttggacaccgttagagacttgagagctagaggtgttgaattcatctctgttccaggttcttactacgaaaacatgaaggaaagattggctaagtcttctttgaagttggaagaaaagttcgaagacatccaagctttgaacatcttgatcgacttcgacgaaggtggttacttgttgcaattgttcaccaagccattgatggacagaccaaccgttttcatcgaaatcatccaaagaagaaacttcgaaggtttcggtgctggtaacttcaagtctttgttcgaagctatcgaaagagaacaagctaagagaggtaacttg

SEQ ID NO: 153 - DNA, 1182 bp, Yarrowia lipolytica
atgtctccatctgttgaagttaccccagctcacaccccaacctcttacgaagttaccaactctttggactcttacagaggttacgaccacgttcactggtacgttggtaacgctaagcaagctgcttctttctacatcaccagaatgggtttctctccaatcgcttacaagggtttggaaaccggttctagagacgttaccacccacgttgttggtaacggtcaagttagattcgctttctcttctgctttgagaaccggtgaaccacaagctgacgaaatccacgctcacttggttaagcacggtgacgctgttaaggacgttgctttcgaagttgacaacgttgaacaattgttctctgctgctgttaagaagggtgttagagttatctctgaaccaaaggttttgaaggacgctcaaggttctgttacctacgctgttatctctacctacggtgacaccacccacaccttgatcgaaagaggttcttacgaaggtgctttcttgccaggtttcgttgacacctctgctaacaaggacccaatcgctgctttcttgccaaacatcgaattgatgcacatcgaccactgtgttggtaaccaagactggaacgaaatggacaacgcttgtaagtactacgaagaaaccttgggtttccacagattctggtctgttgacgacaaggacatctgtaccgaattctctgctttgaagtctgttgttatggcttctccaaacgaaaagatcaagatgccagttaacgaaccagctgttggtaagaagaagtctcaaatcgaagaatacatcgacttctacgacggtccaggtatccaacacatcgctttgagaaccgactgtatcttggacaccgttagagacttgagagctagaggtgttgaattcatctctgttccaggttcttactacgaaaacatgaaggaaagattggctaagtcttctttgaagttggaagaaaagttcgaagacatccaagctttgaacatcttgatcgacttcgacgaaggtggttacttgttgcaattgttcaccaagccattgatggacagaccaaccgttttcatcgaaatcatccaaagaagaaacttcgaaggtttcggtgctggtaacttcaagtctttgttcgaagctatcgaaagagaacaagctaagagaggtaacttg

SEQ ID NO: 154 - DNA, 1179 bp, Homo sapiens
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 155 - DNA, 1131 bp, Homo sapiens
tggtactgggacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttgttaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatctgtcacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 156 - DNA, 1125 bp, Homo sapiens
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagttagaccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 157 - DNA, 1179 bp, Rattus norvegicus
atgaccacctacaccgacaagggtgaaaagccattgagaggtagattcatccacttccactctatcaccttctgggttggtaacgctaagcaagctgcttcttactactgtaacaagatgggtttcgaagaattggcttacagaggtttggaaaccggttctagagaagttgtttctcacgttatcaagcaagacaagatcgttttcgttttgtcttctgctttgaacccaggtaacgaagaaatgggtgaacacttggttaagcacggtgacggtgttaaggacatcgctttcgaagttgaagactgtgacttcatcgttcaaaaggctaaggaaagaggtgctgttgttgttaaggaaccatgggttgaagaagacaagttcggtaaggttaagttcgctgttatccaaacctacggtgacaccacccacaccttgatcgaaaagttgaactacaagggtttgttcttgccaggttaccacccaccattgttcaaggacccattgttgccaaagttgccatctgctaagttgaacttcgttgaccacgttgttggtaaccaaccagacttgcaaatggttccagttgctgactggtaccaaaagaacttgttgttccacagattctggtctgttgacgacaagcaattgcacaccgaattctctgctttgagatctatcgttgttaccaactacgaagaaaccatcaagatgccaatcaacgaaccagctttcggtaagaagaagtctcaaatccaagaatacgttgactactacggtggtgctggtgttcaacacatcgctttgaacacctctgacatcatctctgctatcaccaacttgaagcaaagaggtatgcaattcatggacgttccatcttcttactaccaaatgttgagagaaagattgaagaccgctaagatcaaggttaaggaaaacatcgacaagttggctgaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttcgaagctatcgaaatcgaccaagacgctagaggtaacttgaccatcttggaaccaaacggtgaaaccaagagaatc

SEQ ID NO: 158 - DNA, 1179 bp, Mus musculus domesticus
caaaccacctacaccgacaagggtgaaaagccattgagaggtagattcatccacttccactctatcaccttctgggttggtaacgctaagcaagctgcttcttactactgtaacaagttgggtttcgaagaattggcttacagaggtttggaaaccggttctagagaagttgtttctcacgttatcaagcaagacaagatcgttttcgttttgtcttctgctttgaacccaggtaacgaagaaatgggtgaacacttggttaagcacggtgacggtgttaaggacatcgctttcgaagttgaagactgtgacttcatcgttcaaaaggctagagaaagaggtgctgttgttgttaaggaaccatgggttgaagaagacaagttcggtaaggttaagttcgctgttatccaaacctacggtgacaccacccacaccttggttgaaaagttgaactacaagggtttgttcttgccaggttaccaccaaccattgttcaaggacccattgttgccaaagttgccatctgctaagttgtctttcgttgaccacgttgttggtaaccaaccagacttgcaaatggttccagttgctgactggtaccaaaagaacttgttgttccacagattctggtctgttgacgacaagcaattgcacaccgaattctctgctttgagatctatcgttgttaccaactacgaagaaaccatcaagatgccaatcaacgaaccagctttcggtaagaagaagtctcaaatccaagaatacatcgactactacggtggtgctggtgttcaacacatcgctttgaacacctctgacatcatctctgctatcaccaacttgaagcaaagaggtatgcaattcatggacgttccatcttcttactaccaagttttgagagaaagattgaagaccgctaagatcaaggttaaggaaaacatcgacaagttggctgaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttcgaagctatcgaaatggaccaagacgctagaggtaacttgaccatcttggaaccaaacggtgaaaccaagagaatc

SEQ ID NO: 159 - DNA, 1179 bp, Mus musculus
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacaaggacatgggtgaacacttggttaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaaccaccattgttcaaggacccattgttgccaaagttgccatctggtaagttgtctttcatcgaccacgttgttggtaaccaaccagacttgcaaatggttccagttgctgaatggtaccaaaagaacttgttgttccacagattctggtctgttgacgacaagcaattgcacacccaattctctgctttgagatctatcgttgttgctaactacgaagaaaccatcaagatgccaatcaacgaaccagctgttggtaagaagaagtctcaaatccaagaatacgttgaatactacggtggtgctggtgttcaacacatcgctttgaacaccccagacatcatcaccgctgttaccaacttgaagcaaagaggtatcgaattcatgaccgttccatctacctactaccaacaattgagagaaaagttgaagtctgctaagatcaaggttaaggaaaacatcgacaagttggaagaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaacttcatc

SEQ ID NO: 160 - DNA, 1179 bp, Homo sapiens
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacaaggaaatgggtgaacacttggttaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaattgccattgttcaaggacccattgttgccaaagttgccatctggtaagttgtctttcatcgaccacgttgttggtaaccaaccagacttgcaaatggttccagttgctgaatggtaccaaaagaacttgttgttccacagattctggtctgttgacgacaagcaattgcacacccaattctctgctttgagatctatcgttgttgctaactacgaagaaaccatcaagatgccaatcaacgaaccagctgttggtaagaagaagtctcaaatccaagaatacgttgaatactacggtggtgctggtgttcaacacatcgctttgaacaccccagacatcatcaccgctgttaccaacttgaagcaaagaggtatggaattcatgaccgttccatctacctactaccaacaattgagagaaaagttgaagtctgctaagatcaaggttaaggaaaacatcgacaagttggaagaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaacttcatc

SEQ ID NO: 161 - DNA, 1179 bp, Rattus norvegicus
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacaaggaaatgggtgaacacttgttgaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaaccaccattgttcaaggacccattgttgccaaagttgccatctggtaagttgtctttcatcgaccacgttgttggtaaccaaccagacttgcaaatggttccagttgctgaatggtaccaaaagaacttgttgttccacagattctggtctgttgacgacaagcaattgcacacccaattctctgctttgagatctatcgttgttgctaactacgaagaaaccatcaagatgccaatcaacgaaccagctatgggtaagaagaagtctcaaatccaagaatacgttgaatactacggtggtgctggtgttcaacacatcgctttgaacaccccagacatcatcaccgctgttaccaacttgaagcaaagaggtatggaattcatgaccgttccatctacctactaccaacaattgagagaaaagttgaagtctgctaagatcaaggttaaggaaaacatcgacaagttggaagaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaacttcatc

SEQ ID NO: 162 - DNA, 1179 bp, Mus musculus
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacgaagaaatgggtgaacacttggttaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaaccaccattgttcaaggacccattgttgccaaagttgccatctggtaagttgtctttcatcgaccacgttgttggtaaccaattggacttgcacatggttccagttgctgaatggtaccaaaagaacttgttgttccacagattctggtctgttgacgacaagcaattgcacacccaattctcttctttgagatctatcgttgttgctaactacgaagaaaccatcaagatgccaatcaacgaaccagctatgggtatgaagaagtctcaaatccaagaatacgttgaatactacggtggtgctggtgttcaacacatcgctttgaacacctctgacatcatcaccgctgttaccaacttgaagcaaagaggtatggaattcatggttgttccatctacctactaccaacaattgagagaaaagttgaagtctgctaagatcaaggttaaggaaaacatcgacaagttggaagaattgaagatcttggttgacttcgacggtaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaactcttgt

SEQ ID NO: 163 - DNA, 1179 bp, Bos taurus
atgaccacctacaccgacaagggtcaaaagccagaaagaggtagattcttgcacttccactctatcaccttctgggttggtaacgctaagcaagctgcttcttactactgtaacaagatgggtttcgaagaaatggcttacagaggtttggaaaccggttctagagaagttgtttctcacgttatcagacaagacaagatcgttttcgttttgtcttctgctttgaacccaggtaacgaagaaatgggtgctcacttggttaagcacggtgacggtgttaaggacgttgctttcgaagttgaagactgtgacttcatcgttcaagaagctagagaaagaggtgctgctatcgttaaggaaccatgggttgaagaagacaagcacggtagagttaagttcgctgttatccaaacctacggtgacaccacccacaccttggttgaaaagttgaactacggtggtttgttcttgccaggtttcgaagctccattgttcaaggaccaattgttgccaaagttgccatctaccaagttgagattcatcgaccacgttgttggtaaccaaccagacttggaaatggttccagttgctgaatggtaccaaagaaacttgttgttccacagattctggtctgttgacgacaagcaattgcacaccgaattctctgctttgagatctatcgttgttgctaactacgaagaaaccatcaagatgccaatcaacgaaccagctgttggtaagaagaagtctcaaatccaagaatacatcgactactacggtggtccaggtgttcaacacatcgctttgaacacctctgacatcatctctgctatcaccaacttgaagcaaagaggtatggaattcatgtctgttccagctacctactaccaacaattgagacaaagattgaagaccgctaagatcgaagttaaggaatctatcgacaagttggaagaattgaagatcttggttgacttcgacgaaaagggttacttgttgcaaatcttcaccaagccagttcaagacagaccaaccttgttcttggaagttatccaaagatacaaccaccaaggtttcggtgctggtaacttcaagtctttgttcgaagctatcgaagctgaccaagacgctagaggtaacttgaccttgttgacctctaacgttgaaaacaacttcatc

SEQ ID NO: 164 - DNA, 1179 bp, Mus musculus
atgaccacctacaccgacaagggtgaaaagccattgagaggtcaattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaagacaagatcatcttcatcttctcttctgctttgaacccaggtaacaaggaaatgggtgaacacttggttaagcacggtgacggtgttaaggacgttgctttccaagttgaagactgtgacttcatcgttcaaaaggctagagaaagaggtgctgctatcgttaaggaaccatgggttgaacaagacaagaacggtagagttaagttcgctgttttgcaaacctacggtgacaccacccacaccttgatcgaaaagatcgactacaagggtccattcttgccaggttacgaagctccattgttcttggacccattgttgccaaagttgccagcttgtaagttgaacttcatcgaccacgttgttggtaaccaaccagaccacgaaatggttccagctgttgaatggtaccaaaagaacttgttgttccacagattctggtctgttgacgacaagcaagttcacaccgacttctctgctttgagatctatcgttgttgctaactacgaagaaaccatcaagatgccaatcaacgaaccagctttgggtaagaagaagtctcaaatccaagaatacgttgaatactacggtggtgctggtgttcaacacatcgctttgaacacccaagacatcatctctgctatcgctcacttgaaggaaagaggtaccgaattcatgtctgttccatctacctactacacccaattgagagaaaagttgaagaccgctaagatcagagttaaggaaaacatcaagcaattggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcacctctttgttcaaggctatcgaagaagaccaacaagctagaggtaacttgaccgttttgtctccaaacggtgaagtttctgctatg

SEQ ID NO: 165 - DNA, 1179 bp, Homo sapiens
atgacctcttacaccgacagaggtcaaaagccaccaagaggtagattcttgcacttccactctatcaccttctgggttggtaacgctaagcaagctgcttctttctactgtcacaagatgggtttctctccattcgcttacagaggtttggaaaccggttctagagacgttgcttctcacgttgttaagcaaggtaagatcatcttcatcttctcttctgctttgaacccaggtaacaaggaaatgggtgaccacttggttaagcacggtgacggtgttaaggacatctctttcgaagttgaagactgtgactacatcgttcaaaaggctagagaaagaggtgctatcatcgttaaggaaccatggaccgaacaagacaagttcggttgggttaagttcgctgttttgcaaacctacggtgacaccacccacaccttggttgaaaagttgaactacaccggtccattcttgccaggtttcgaagctccattgttcgaagacccattgttgccaaccttgccagactgtaagttggctatgatcgaccacgttgttggtaaccaaccagaccaagaaatggttccagctgctgactggtacaagaagaacttgatgttccacagattctggtctgttgacgacaagcaagttcacaccgaattctcttctttgagatctatcgttatggctaactacgaagaaaccatcaagatgccaatcaacgaaccagctatgggtagaaagaagtctcaaatccaagaatacgttgactactacggtggtgctggtgttcaacacatcgctatgtctaccccagacatcatctctgctatcacctacttgagagctagaggtttggaattcttgtctgttccatctacctactacaagcaattgagagaaggtttgaagtctgctaagatccaagttaaggaatctatcgacaccttggaagaattgaagatcttggttgactacgacgaaaagggttacttgttgcaaatcttcaccaagccagttcaagacagaccaaccgttttcttggaagttatccaaagacacaaccaccaaggtttcggtgctggtaacttcaactctttgttcaaggctttcgaagaagaacaaaacatcagaggtaacttgaccgacttggctccaaacggtttgggtatcgttatg

SEQ ID NO: 166 - DNA, 1179 bp, Pan troglodytes
atgacctcttacaccgacagaggtgaaaagccaccaagaggtagattcttgcacttccactctatcaccttctgggttggtaacgctaagcaagctgcttctttctactgtcacaagatgggtttctctccattggcttacagaggtttggaaaccggttctagagaagttgcttctcacgttgttaagcaaggtaagatcatcttcatcttctcttctgctttgaacccaggtaacaaggaaatgggtgaccacttggttaagcacggtgacggtgttaaggacatctctttcgaagttgaagactgtgactacatcgttcaaaaggctagagaaagaggtgctatcatcgttaaggaaccatggatcgaacaagacaagttcggttgggttaagttcgctgttttgcaaacctacggtgacaccacccacaccttggttgaaaagttgaactacaccggtccattcttgccaggtttcgaagctccattcttcgaagacccattgttgccaaccttgccagactgtaagttggctatgatcgaccacgttgttggtaaccaaccagaccaagaaatggttccaatcgctgactggtacaagaagaccttgatgttccacagattctggtctgttgacgacaagcaagttcacaccgaattctcttctttgagatctatcgttatggctaactacgaagaaaccatcagaatgccaatcaacgaaccagctatgggtagaaagaagtctcaaatccaagaatacgttgactactacggtggtgctggtgttcaacacatcgctatgtctaccaccgacatcatctctgctatcacccacttgagagctagaggtatggaattcttgaacgttccatctacctactacaagcaattgagagaaagattgaagtctgctaagatccaagttaaggaaaacatggacatcttggaaaagttgaagatcttggttgactacgacgaaaagggttacttgttgcaaatcttcaccaagccagttcaagacagaccaaccgttttcttggaagttatccaaagacacaaccaccaaggtttcggtgctggtaacttcaactctttgttcaaggctttcgaagaagaacaaaacatcagaggtaacttgaccgacttggctccagacggtttgggtaccgttatg

SEQ ID NO: 167 - DNA, 1179 bp, Cricetulus griseus
atgaccacctacaccgacagaggtgaaaagccaccaagaggtagattcttgcacttccactctatcaccttctgggttggtaacgctaagcaagctgcttctttctactgtaacaagatgggtttctctccattggcttacagaggtttggaaaccggttctagagaagttgcttctcacgttgttaagcaaggtaagatcatcttcatcttctcttctccattgaacccaggtaacaaggaaatgggtgaccacttggttaagcacggtgacggtgttaaggacatctctttcgaagttgaagactgtgactacatcgttcaaaaggctagagaaagaggtgctgttatcgttaaggaaccatggatcgaacaagacaagttcggtagagttaagttcgctatcttgcaaacctacggtgacaccacccacaccttggttgaaaagttgaactacaccggtccattcttgccaggtttcgaaaccccaagattcttggacccattgttgccaaagttgccagactgtaagttggctatgatcgaccacgttgttggtaaccaaccagaccaagaaatggttaccgctgctgaatggtacaagaagaacttgttgttccacagattctggtctgttgacgacaagcaagttcacaccgaattctcttctttgagatctatcgttatggctaactacgaagaaaccatcaagatgccaatcaacgaaccagctatgggtagaaagaagtctcaaatccaagaatacgttgactactacggtggtgctggtgttcaacacatcgctatgtctaccccagacatcatctctgctatcacccacttgaaggctagaggtatggaattcttgtctgctccagctacctactacaagcaattgagagaaggtttgaaggctgctaagatgcaagttaaggaaaacatcgacaagttggaagaattgaagatcttggttgactacgacgaaaagggttacttgttgcaaatcttcaccaagccagttcaagacagaccaaccgttttcttggaagttatccaaagacacaaccaccaaggtttcggtgctggtaacttcaacgctttgttcaaggctttcgaagaagaacaatctgttagaggtaacttgaccgacttggctccaaacggtgttggtatcgctatg

SEQ ID NO: 168 - DNA, 1179 bp, Saimiri boliviensis boliviensis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacatcgttcaaaaggctagagaaagaggtgctaagatcgttcaagaaccatgggttgaagaagacaagttcggtaaggttaagttcgctgttttgcaaacctacggtgacaccacccacaccttggttgaaaagaccaactacaccggtagattcttgccaggtttcgaagctccattgttgaaggactctttgttgccaaagttgccaaagtgtggtttggaaatcatcgaccacgttgttggtaaccaaccagaccaagaaatgttgtctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtagaaagaagtctcaaatccaagaatacgttgactacaacggtggtgctggtgttcaacacatcgctttgaagacccaagacatcatcaccgctatcagatctttgagagacagaggtttggaattcttgtctgttccatctacctactacaagcaattgagagaaaacttgaagaccgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctatcagaggtaacttgaccgacttggaaatcaagggtgaagtttctggtatg

SEQ ID NO: 169 - DNA, 1152 bp, Felis catus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacatcgttcaaaaggctagagaacaaggtgctaagatcgttagagaaccatgggttgaagaagacaagttcggtaaggttaagttcgctgttttgcaaaccttcggtgacaccacccacaccttggttgaaaagaccaactactctggtagattcttgccaggtttcaaggctccattgttgaaggactctttgttgccaaagttgccaagatgtggtttggaaatcatcgaccacgttgttggtaacttgttggaccacgaaatgtcttctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtatgaagaagtcttctatccaagaatacgttgactacaacggtggtgctggtgttcaacacgttggtttgaagacccaagacatcatcaccaccatcagaaacttgcaagaaagaggtatggaattcttgaccgttccatctacctactacaagcaattgagagaaaacttgaagaccgctaagatcagagttaaggaatctatcgacgttttggaagaattgcaaatcttgatggactacgacgaaaagggttacatcttgcaaatcttcaccaagccaatgcaagacagaccaaccttgttcttggaagttatccaaagacacaaccaccaaggtttcggtgctggtaacttcaactctttgttcaaggctttggaagacgctcaagaattgagaggtaacttgaccaacttg

SEQ ID NO: 170 - DNA, 1152 bp, Ovis aries
atgaccacctacaccgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacatcgttcaaaaggctagagaaagaggtgctaaggttgttagagaaccatgggttgaagaagacaagttcggtaaggttaagttcgctgttttgcaaaccttcggtgacaccacccacaccttggttgaaaagaccaactactctggtagattcttgccaggtttccaagctccattgttgaaggactctttgttgccaaagttgccaaagtgtggtttggaaatcatcgaccacgttgttggtaacttgttggaccacgaaatgttgtctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtatgaagaagtcttctatccaagaatacgttgactacaacggtggtgctggtgttcaacacgttggtttgaagacccaagacatcatcaccaccatcagaaacttgcaagaaagaggtatggaattcttgaccgttccatctacctactacaagcaattgagagaaaacttgaagaccgctaagatccaagttaaggaatctatcgacgttttggaagaattgcaaatcttgatggactacgacgaaaagggttacatcttgcaaatcttcaccagaccaatgcaagacagaccaaccttgttcttggaagttatccaaagacacaaccaccaaggtttcggtgctggtaacttcaactctttgttcaaggctttggaagacgctcaagaattgagaggtaacttgaccaacttg

SEQ ID NO: 171 - DNA, 1152 bp, Orcinus orca
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacgttgttcaaaaggctagagaaagaggtgctaagatcgttagagaaccatgggttgaagaagacaagttcggtaaggttaagttcgctgttttgcaaaccttcggtgacaccacccacaccttggttgaaaagaccaactactctggtcaattcttgccaggtttcaaggctccattgttgaaggactctttgttgccaaagttgccaagatgtggtttggaaatcatcgaccacgttgttggtaacttgccagaccaagaaatgttgtctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtatgaagaagtcttctatccaagaatacgttgactacaacggtggtgctggtgttcaacacgttggtttgaagacccaagacatcatcaccaccatcagaaacttgcaagaaagaggtatggaattcttgaccgttccatctacctactacaagcaattgagagaaaacttgaagaccgctaagatcagagttaaggaatctatcgacgttttggaagaattgcaaatcttgatggactacgacgaaaagggttacatcttgcaaatcttcaccaagccaatgcaagacagaccaaccttgttcttggaagttatccaaagacacaaccaccaaggtttcggtgctggtaacttcaactctttgttcaaggctttggaagacgctcaagaattgagaggtaacttgaccaacttg

SEQ ID NO: 172 - DNA, 1170 bp, Odobenus rosmarus divergens
atgaccacctactctaacaagggtgttaagccagaaagaggtcaattcttgcacttccactctgttaccttctgggttggtaacgctaagcaagctgcttctttctactgtaacaagatgggtttcgaaccattcgcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaatcttgggttgaacaagacaagttcggtaaggttaagttcgctgttttgcaaacctacggtgacaccacccacaccttggttgaaaagatgggttacaccggtagattcttgccaggtttcgaagctccagctatcaaggacccattgttggctaagttgccatcttgttctttggaagttatcgaccacatcgttggtaaccaaccagaccaagaaatggttccagtttctgactggtacgttaagaacttgcaattccacagattctggtctgttgacgacacccaagttcacaccgaatactcttctttgagatctatcgttgttgctaactacgaagaaaccatcaagatgccaatcaacgaaccagctcaaggtagaaagaagtctcaaatccaagaatacgttgactacaacggtggtgctggtgttcaacacatcgctttgaagacccaagacatcaccaccaccatcagacacttgagagaaagaggtttggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagacgaacaaaacagaagaggtaacttgaccgacttgggtaccaacggtgttcca

SEQ ID NO: 173 - DNA, 1179 bp, Dasypus novemcinctus
atgaccacctactctgacaagggtgttaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttgttaagcaagacaagatcgttttcgttttgtcttctgctttgaacccaggtaacaaggaaatgggtgaccacttggttaagcacggtgacggtgttaaggacatcgctttcgaagttgaagactgtgcttctatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacaccggtagattcttgccaggtttcgaagctccagttatcaccgacccattgttggctaagttgccatcttgtagattggaaatcatcgaccacatcgttggtaaccaaccagaccaagaaatggtttctgcttctgaatggtacgttaagaacttgcaattccacagattctggtctgttgacgacacccaagttcacaccgaatactcttctttgagatctatcgttgttgctaactacgaagaaaccatcaagatgccaatcaacgaaccagctcaaggtaagaagaagtctcaaatccaagaatacgttgactacaacggtggtgctggtgttcaacacatcgctttgaagacccaagacatcatcaccgctatcagacacttgaaggaaagaggtttggaattcttggctgttccatctacctactacagacaattgagagaaaagttgaagaccgctaagatcaaggttaaggaatctatcgacatcttggaagaattgaagatcttggttgacttcgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaagttgagaggtaacttgaccgacttgggtgctaacggtgttttgccaggtatg

SEQ ID NO: 174 - DNA, 1275 bp, Jaculus jaculus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatctctgcttcttggcaaccaagagaaggtcaaggtggtagacaaagatctggtaccgaagaaccaagagttccagctttgtgtcaagaaggttctcac

SEQ ID NO: 175 - DNA, 1182 bp, Mustela putorius furo
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatgcaa

SEQ ID NO: 176 - DNA, 1182 bp, Heterocephalus glaber
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacttgaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatgcaa

SEQ ID NO: 177 - DNA, 1221 bp, Microtus ochrogaster
atgccattcgaaggtcaattgcacttgatcgactctttgaccaagaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 178 - DNA, 1179 bp, Chinchilla lanigera
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 179 - DNA, 1179 bp, Macaca fascicularis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 180 - DNA, 1179 bp, Equus caballus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagacaaagaggtatggaattcttgtctgttccatctacctactacaagcaattgagagaaaagttgaagaccgctaagatcaaggttaaggaaaacatcgaagttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 181 - DNA, 1179 bp, Bos mutus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagacaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 182 - DNA, 1179 bp, Vicugna pacos
atgaccacctactctgacaagggtgctaagccagaaagaggtagattcttgcacttccactctgttaccttctgggttggtaacgctaagcaagctgtttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggctaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgtctgacttggaaaccaacggtgttgttccaggtatg

SEQ ID NO: 183 - DNA, 1179 bp, Myotis davidii
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 184 - DNA, 1179 bp, Leptonychotes weddellii
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccaccatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 185 - DNA, 1179 bp, Peromyscus maniculatus bairdii
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaaccaccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 186 - DNA, 1179 bp, Panthera tigris altaica
atgaccacctactctgacaagggtgctaagccagaaagaggtagattcttgcacttccactctgttaccttctgggttggtaacgctaagcaagctacctctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 187 - DNA, 1179 bp, Physeter catodon
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 188 - DNA, 1179 bp, Bubalus bubalis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgtagattggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 189 - DNA, 1179 bp, Balaenoptera acutorostrata scammoni
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 190 - DNA, 1179 bp, Lipotes vexillifer
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacagacaattgagagaacaattgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaacctctggtgttgttccaggtatg

SEQ ID NO: 191 - DNA, 1179 bp, Carlito syrichta
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacagacaattgagagaacaattgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaacctctggtgttgttccaggtatg

SEQ ID NO: 192 - DNA, 1179 bp, Oryctolagus cuniculus
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttcaagaaccatgggttgaagaagacaagttcggtaaggttaagttcgctgttttgcaaaccttcggtgacatcacccacaccttggttgaaaagatgtcttacgctggtagattcttgccaggttacgaagctccagttttcatggacccattgttgccacaattgccaaagtgttctttgaaggttatcgaccacatcgttggtaaccaaccagaccaagaaatggcttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgaatacaacggtggtgctggtgttcaacacatcgctttgaagacccaagacatcatcaccgctatcagacacttgagagaaagaggtttggaattcttgtctgttccatctacctactacaagcaattgagagaaaagttgaaggttgctaagatcaaggttaaggaatctatcgacgttttggaagaattgaagatcttggttgacttcgacgaaaagggttacttgttgcaaatcttcaccaagccagttcaagacagaccaaccttgttcttggaagttatccaaagacacaaccaccaaggtttcggtgctggtaacttcaactctttgttcaaggctatcgaagaagaacaaaacttgagaggtaacttgaccaacagagaaaccgacggtgttgttccaggtatg

SEQ ID NO: 193 - DNA, 1179 bp, Galeopterus variegatus
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagagaagttgtttctcacgttatcaagcaaggtaagatcgttttcgttttgtcttctgctttgaacccatgggacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacgctggtagattcttgccaggttacgaagctccagttttcatggacccattgttgccacaattgccaaagtgttctttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttgtctgttccatctacctactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccgacggtgttgttccaggtatg

SEQ ID NO: 194 - DNA, 1179 bp, Nannospalax galili
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagagaagttgtttctcacgttatcaagcaaggtaagatcgttttcgttttgtcttctgctttgaacccatggaacaaggaaatgggtaaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgtcttacgctggtagattcttgccaggttacgaagctccagctttcatggacccattgttgccacaattgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttgtctgttccatctacctactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccgacggtgttgttccaggtatg

SEQ ID NO: 195 - DNA, 1179 bp, Mesitornis unicolor
atgaccacctactctgacaagggtgctaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaacttcggtaaggttaagttcgctgttttgcaaacctacggtgacaccacccacaccttggttgaaaagatgaactacgctggtagattcttgccaggttacaaggctccagctttcatggacccattgttgccacaattgccaaagtgttctttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagaggtagaggtatggaattcttgtctgttccatctatgtactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccaacatggaaaccgacggtgttgttccaggtatg

SEQ ID NO: 196 - DNA, 1179 bp, Rhinopithecus roxellana
atgaccacctactctgacaagggtgctaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacgctggtagattcttgccaggttacaaggctccagctttcatggacccattgttgccacaattgccaaagtgttctttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagaggtagaggtatggaattcttgtctgttccatctacctactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccaacatggaaaccgacggtgttgttccaggtatg

SEQ ID NO: 197 - DNA, 1179 bp, Fukomys damarensis
atgaccacctactctaacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgtttctcacgctatcaagcaaggtcaaatcgttttcgttttgtcttctgctttgaacccatggaacaaggaaatgggtgaccacttggttaagcacggtgacggtgttaaggacatcgctttcgaagttgaagactgtgactacatcgttcaaaaggcttgggaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccaatgttcaaggacttgttgttgtctagattgccatcttgttctttggaaatcatcgaccacatcgttggtaaccaaccagaccaagaaatggttccagcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggctgttccatctacctactacaagcaattgagagaaaagttgaagaccgctaagatcagagttaaggaatctatcgacgttttggaagaattgaagatcttggttgactacgacgaaaagggttacttgttgcaaatcttcaccaagccagttcaagacagaccaaccttgttcttggaaatcatccaaagacacaaccaccaaggtttcggtgctggtaacttcaactctttgttcaaggctttcgaagaagaacaagacttgagaggtaacttgaccgacttggaaaccaacggtgctgctccaggtacc

SEQ ID NO: 198 - DNA, 1179 bp, Colobus angolensis palliatus
atgaccacctactctaacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgtttctcacgttatcaagcaaggtcaaatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgggttacaccggtagattcttgccaggtttcgaagctccagctttcagagacccattgttgccaaagttgccaaactgtaccttggaaatcatcgaccacatcgttggtaaccaaccagaccaagaaatggttccagcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtaccgaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttgttccaggtatg

SEQ ID NO: 199 - DNA, 1179 bp, Colobus angolensis palliatus
atgaccacctactctaaccaaggtgaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttatcaagcaaggtaagatcgttttcgttttctcttctgctttgaacccatggaacagagaaatgggtgaccacttggttaagcacggtgacggtgttaaggacatcgctttcgaagttgaagactgtgactacatcgttcaaaaggctagagaaagaggtgctaagatcgttcaagaaccatgggttgaacaagacaagttcggtaaggttaagttcgctgttttgcaaacctacggtgacaccacccacaccttggttgaaaagatgaactactctggttgtttcttgccaggtttcgaaccattggttttcaccgacccattgttgtctaagttgccaaagtgttacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtttggaattcttggctgttccaccaacctactacaagcaattgagagaaaagttgaagtctgctaagatcagagttaaggaatctatcgacaccttggaagaattgaaggttttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccgacatggaagctaacggttctatgccaggtaga

SEQ ID NO: 200 - DNA, 1179 bp, Mandrillus leucophaeus
atgaccacctactctaaccaaggtgaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttatcaagcaaggtaagatcgttttcgttttctcttctgctttgaacccatggaacagagaaatgggtaaccacttggttaagcacggtgacggtgttaaggacatcgctttcgaagttgaagactgtgactacatcgttcaaaaggctagagaaagaggtgctaagatcgttcaagaaccatgggttgaacaagacaagttcggtaaggttaagttcgctgttttgcaaacctacggtgacaccacccacaccttggttgaaaagatgaactactctggttgtttcttgccaggtttcgaaccattggttttgaccgacccattgttgtctaagttgccaaagtgttacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtttggaattcttggctgttccaccaacctactacaagcaattgagacaaaagttgaagtctgctaagatcagagttaaggaatctatcgacaccttggaagaattgaaggttttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccgacatggaagctaacggttctatgccaggtaag

SEQ ID NO: 201 - DNA, 1179 bp, Macaca nemestrina
atgaccacctactctaacaagggtgaaaagccagaaagaggtagattcttgcacttccactctgttaccttctgggttggtaacgctaagcaagctgcttctttctactgttctaagatgggtttcaagccattggcttacaagggtttggaaaccggttctagagaagttgtttctcacgttatccaacaaggtaagatcgttttcgttttgtcttctgctttgaacccatggaacaccgaaatgggtgaccacttggttaagcacggtgacggtgttaaggacatcgctttcgaagttgaagactgtgactacatcgttcaaaaggctcaagaaagaggtgctaagatcatgagagaaccatgggttgaacaagacaagttcggtaaggttaagttcgctgttttgcaaacctacggtgacaccacccacaccttggttgaaaagatgaactactctggtagattcttgccaggtttcgaagctccagctttcaccgacccattgttgtctaagttgccagactgttgtttggaaatcatcgaccacgttgttggtaaccaaccagaccaagaaatggtttctgcttctgaatggtacgttaagaacttgcaattccacagattctggtctgttgacgacacccaagttcacaccgaatactcttctttgagatctatcgttgttgctaactacgaagaaaccatcaagatgccaatcaacgaaccagctcaaggtaagaagaagtctcaaatccaagaatacgttgactacaacggtggtccaggtgttcaacacatcgctttgaagacccaagacatcatcaccgctatcagacacttgagagaaagaggtttggaattcttgggtgttccatctacctactacaagcaattgagagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtgttggtccaggtatc

SEQ ID NO: 202 - DNA, 1179 bp, Aotus nancymaae
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctatgttgcaaacctacggtgacaccacccacaccttggttgaaaagatgaactacaccggtagattcttgccaggtttcgaagctccagcttctgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtgctggtgttcaacacatcgctttgaagacccaagacatcatcaccgctatcagacacttgagagaaagaggtttggaattcttggctgttccatctacctactacaagcaattgagagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccaacttggaaaccaacggtatcttgagaggtatg

SEQ ID NO: 203 - DNA, 1179 bp, Propithecus coquereli
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctagaatcgttagagaaccatggaccgaagaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtgctggtgttcaacacatcgctttgaagacccaagacatcatcaccgctatcagacacttgagagaaagaggtttggaattcttggctgttccatctacctactacaagcaattgagagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtatcttgagaggtatg

SEQ ID NO: 204 - DNA, 1179 bp, Otolemur garnettii
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacttggttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccaatctctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgaaggctagaggtatggaattcttgggtgttccatcttcttactacaagcaattgagagaaaagttgaagaccgctaagatccaagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccaacttggaaaccaactcttctttgagaggtatg

SEQ ID NO: 205 - DNA, 1179 bp, Cavia porcellus
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacttggttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagtttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgaaggctagaggtatggaattcttgggtgttccatcttcttactacagacaattgagagaaaagttgaagaccgctaagatccaagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccaacttggaaaccaactcttctttgagaggtatg

SEQ ID NO: 206 - DNA, 1179 bp, Myotis brandtii
atgaccacctactctgacagaggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagctagaggtatggaattcttgggtgttccatcttcttactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtaccttgagatgtatg

SEQ ID NO: 207 - DNA, 1179 bp, Equus asinus
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagctagaggtatggaattcttgtgtgttccatcttcttactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtaccttgagaggtatg

SEQ ID NO: 208 - DNA, 1383 bp, Marmota marmota marmota
gacgacatcaccttgtctaccgaagctgctgctagatctgaagctccaaagccaggttctttccaaagatggtgtagataccacccatctttgggtagaccaggttctaagggtagagacttgttcggtgttaagtacttctgtccagctttgcactggccattggttccaatctctgaacaagaagcttctccaagatctaccatgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagctagaggtatggaattcttgtgtgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttgcaaaccaacggtaccttgagaggtatg

SEQ ID NO: 209 - DNA, 1179 bp, Marmota marmota marmota
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcatgagagaaccatggatcgaagaagacaagttcggtaaggttaagttggctgttttgcaaacctacggtgacaccacccacaccttggttgaaaagatcaactacaccggtagattcttgccaggtttcgaagctccagcttgtgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagacagaggtatggaattcttggctgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtatgatgccaggtatg

SEQ ID NO: 210 - DNA, 1179 bp, Cebus imitator
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaagaagacaagttcggtaaggttaagttggctgttttgcaaacctacggtgacaccacccacaccttggttgaaaagatcaactacaccggtagattcttgccaggtttcgaagctccagcttgtgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagacagaggtatggaattcttggctgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtatgatgccaggtatg

SEQ ID NO: 211 - DNA, 1179 bp, Capra hircus
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaagaagacaagttcggtaaggttaagttggctgttttgcaaacctacggtgacaccacccacaccttggttgaaaagatgaactacaccggtagattcttgccaggtttcgaagctccagcttgtgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagacagaggtatggaattcttggctgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtaccatgccaggtatg

SEQ ID NO: 212 - DNA, 1179 bp, Panthera pardus
atgaccacctactctgacaagggtagaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggttggttcttgccaggtttcgaaaccccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttgaagaacaccagaaccttgccaggtacc

SEQ ID NO: 213 - DNA, 1179 bp, Hipposideros armiger
atgaccacctactctgacaagggtagaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggttggttcttgccaggtttcgaaaccccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttgaagaacaccagaaccttgccaggtatg

SEQ ID NO: 214 - DNA, 1179 bp, Crocodylus porosus
atgaccacctactctgacaagggtaagaagccacaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggtagattcttgccaggtttcgaaaccccagcttctgttgacccattgttgtctaagttgccatcttgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaatgtactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaacaccagaaccttgccaggtatg

SEQ ID NO: 215 - DNA, 1179 bp, Ailuropoda melanoleuca
atgaccacctactctgacaagggtaagaagccacaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggtagattcttgccaggtttcgaaaccccagcttctgttgacccattgttgtctaagttgccatcttgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaacaccagaaccttgccaggtatg

SEQ ID NO: 216 - DNA, 1176 bp, Bos indicus
accacctactctgacaagggtaagaagccacaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggtagattcttgccaggtttcgaaaccccagcttctgttgacccattgttgtctaagttgccatcttgttctttggaaatggttgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgactctgaaaacaccagaaccttgccaggtatg

SEQ ID NO: 217 - DNA, 1179 bp, Castor canadensis
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaacaacggtatcgttccaggtatg

SEQ ID NO: 218 - DNA, 1179 bp, Sus scrofa
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgctcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaacaacggtatcgttccaggtatg

SEQ ID NO: 219 - DNA, 1179 bp, Microcebus murinus
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgctatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgtctttggaagttatccaaagacacaagcaccaaggtttcggtgctggtaacttcaactctttgttcaaggctttcgaagaagaacaaaacttgagaggtaacttgaccgacttggaaaacaacggtatcgttccaggtatg

SEQ ID NO: 220 - DNA, 1179 bp, Odocoileus virginianus texanus
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccaaccttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaacaacggtatcgttccaggtatg

SEQ ID NO: 221 - DNA, 1179 bp, Phascolarctos cinereus
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttcgaaaacaacggtatcgttccaggtatg

SEQ ID NO: 222 - DNA, 1179 bp, Mus pahari
tcttctttgtcttcttctttgttgttgcaaccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatgggacaaggaaatgggtgaccacttggttaagcacggtgacggtgttaaggacatcgctttcgaagttgaagactgtgactacatcgttcaaaaggctaaggaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagttttcatcgacccaatcttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtaccgttagaggtatg

SEQ ID NO: 223 - DNA, 1179 bp, Mus caroli
atgaccacctactctgacaagggtgaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgctatcaagcaaggtaagatcgttttcgttttctcttctgctttgaacccatggaacaaggaaatcggtgaccacttggctaagcacggtgacggtgttaaggacatcgctttcgaagttgaagactgtgactacatcgttcaaaaggctaaggaaagaggtgctaaggttgttagagaaccatggatcgaacaagacaagttcggtaaggttaagttggctgttttgcaaacctacggtgacaccacccacaccttggttgaaaagatgaactacaccggtttgttcttgccaggtttcgaagctccagttttcttggacccattgttgtctaagttgccatcttgttctttggaaatcatcgaccacatcgttggtaaccaaccagaccaagaaatggtttctgctgctgaatggtacttgaagaacttgcaattccacagattctggtctgttgacgacacccaagttcacaccgaatactcttctttgagatctatcgttgttgctaactacgaagaaaacatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaagattgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 224 - DNA, 1161 bp, Mesocricetus auratus
atgaccacctactctgacaagggtgaaaagccagaaagaggtagattcttgcacttccactctgttaccttctgggttggtaacgctaagcaagctgcttcttactactgttctaagatgggtttcgaaccattggcttacaagggtttggaaaccagatctagagacgttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcacacctacggtgacaccacccacaccttggttgaaaagatgaactacaccggtagattcttgccaggtttcgaagctccagcttctaccgacccattgttgtctaagttgccaaactgttgtttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaacacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaacctct

SEQ ID NO: 225 - DNA, 1161 bp, Meriones unguiculatus
atgaccacctactctgacaagggtgaaaagccagaaagaggtagattcttgcacttccactctgttaccttctgggttggtaacgctaagcaagctgcttcttactactgttctaagatgggtttcgaaccattggcttacaagggtttggaaaccagatctagagacgttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccagcttctaccgacccattgttgtctaagttgccaaactgttgtttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaacacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaacctct

SEQ ID NO: 226 - DNA, 1170 bp, Enhydra lutris kenyoni
atgaccacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccagatctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccagcttctaccgacccattgttgtctaagttgccaaactgtggtttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaacctctggtgttgtt

SEQ ID NO: 227 - DNA, 1176 bp, Delphinapterus leucas
accacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccacagatacaaccaccaaggtttcggtgctggtaacttcaactctttgttcaaggctttcgaagaagaacaagacttgagaggtaacttgaccgacatggaaaccaacggtaccgttgctggtacc

SEQ ID NO: 228 - DNA, 1179 bp, Loxodonta africana
atgaccacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccacagatacaaccaccaaggtttcggtgctggtaacttcaactctttgttcaaggctttcgaagaagaacaagacttgagaggtaacttgaccgacatggaaaccaacggtaccgctgctggtacc

SEQ ID NO: 229 - DNA, 1179 bp, Octodon degus
atgaccacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccacagatacaaccaccaaggtttcggtgctggtaacttcaactctttgttcaaggctttcgaagaagaacaagacttgagaggtaacttgaccgacatggaaaccaacggtaccgttgctggtatg

SEQ ID NO: 230 - DNA, 1179 bp, Chrysemys picta bellii
atgaccacctactctaacaagggtgaaaagccagaaagaggtagattcttgcacttccactctgttaccttctgggttggtaacgctaagcaagctgcttcttactactgttctaagatgggtttcgaatctttggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgctcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagttccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttgctggtatg

SEQ ID NO: 231 - DNA, 1179 bp, Pongo abelii
atgaccacctactctaacaagggtgaaaagccagaaagaggtagattcttgcacttccactctgttaccttctgggttggtaacgctaagcaagctgcttcttactactgttctaagatgggtttcgaatctttggcttacaagggtttggaaaccggttctagagaagttgtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcaccaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttgctggtatg

SEQ ID NO: 232 - DNA, 1179 bp, Terrapene carolina triunguis
atgaccacctactctaacaagggtgaaaagccagaaagaggtagattcttgcacttccactctgttaccttctgggttggtaacgctaagcaagctgcttcttactactgttctaagatgggtttcgaatctttggcttacaagggtttggaaaccggttctagagaaaccgtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgccaaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttccatctatg

SEQ ID NO: 233 - DNA, 1176 bp, Neophocaena asiaeorientalis asiaeorientalis
tctttggctccatctttgttgttgcaaccagaaagaggtagattcttgcacttccactctgttaccttctgggttggtaacgctaagcaagctgcttcttactactgttctaagatgggtttcgaaccattggcttacaagggtttggaaaccggttctagagaaaccgtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttccaggtatg

SEQ ID NO: 234 - DNA, 1179 bp, Theropithecus gelada
  misc_feature (1042)..(1047): n is a, c, g, or t
atgaccacctactctaacaagggtgaaaagccagaaaagggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgctttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccaggtttcgttgacccattgttgtctaagttgccaaactgttctttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacgttgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcnnnnnngttatccaaagatacaaccaccaaggtttcggtgctggtaacttcaactctttgttcaaggctttcgaagaagaacaagacttgagaggtaacttgaccgacatggaaaccaacggtaccacctgtggtatg

SEQ ID NO: 235 - DNA, 1179 bp, Callorhinus ursinus
atgaccacctactctaacaagggtcaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttgaagatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatccaccacttgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtttggttccaggtatg

SEQ ID NO: 236 - DNA, 1179 bp, Vulpes vulpes
atgaccacctactctaacaagggtcaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttgaagatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatccaccacttgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtttggctccaggtatg

SEQ ID NO: 237 - DNA, 1179 bp, Urocitellus parryii
atgaccacctactctaacaagggtcaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatccaccacttgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtttggctccaggtatg

SEQ ID NO: 238 - DNA, 1179 bp, Ursus arctos horribilis
atgaccacctactctaacaagggtgaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtagagttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccattcacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtgttggttctggtatg

SEQ ID NO: 239 - DNA, 1179 bp, Acinonyx jubatus
atgaccacctactctaacaagggtgaaaagccagaaaagggtagattcttgcacttccactctgttaccttctgggttggtaacgctaagcaagctgcttctttctactgtaacaagttgggtttcgaaccattggcttacaagggtttggaaaccggttctagagaagttgtttcttacgttatcaagcaaggtaagatcatcttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgtcttacgctggtagattcttgccaggtttcgaagctccagctttcagagacccattgttgtctaagttgccaaactgttctttggaaatcatcgaccacgttgttggtaaccaaccagaccacgaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatcaccgctatcagacacttgagagaaagaggtatggaattcttggctgttccatcttcttactacagacaattgcaagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccgacatgcaaaccaacatcttggctccaggtaag

SEQ ID NO: 240 - DNA, 1179 bp, Homo sapiens
atgaccacctactctaacaagggtgaaaagccagaaaagggtagattcttgcacttccactctgttaccttctgggttggtaacgctaagcaagctgcttctttctactgtaacaagttgggtttcgaaccattggcttacaagggtttggaaaccggttctagagaagttgtttctcacgttatcaagcaaggtaagatcatcttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgtcttacgctggtagattcttgccaggtttcgaagctccagctttcagagacccattgttgtctaagttgccaaactgttctttggaaatcatcgaccacgttgttggtaaccaaccagaccacgaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatcaccgctatcagacacttgagagaaagaggtatggaattcttggctgttccatcttcttactacagacaattgcaagaaaagttgaagtctgctaagatcagagttaaggaatctatcgacgttttggaagaattgaagatcttggttgactacgacgaaaagggttacttgttgcaaatcttcaccaagccaacccaagacagaccaaccttgttcttggaagttatccaaagacacaaccaccaaggtttcggtgctggtaacttcaacgctttgttcaaggctttcgaagaagaacaagacttgagaggtaacttgaccgacatgcaaaccaacgacttggttccaggtaag

SEQ ID NO: 241 - DNA, 1179 bp, Gulo gulo
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttctggtatg

SEQ ID NO: 242 - DNA, 1179 bp, Bos indicus x Bos taurus
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaaccaccatcttcttggaagttatccaaagacacaaccaccaaggtttcggtgctggtaacttcaactctttgttcaaggctttcgaagaagaacaagacttgagaggtaacttgaccgacatggaaccaaacggtgttgtttctggtatg

SEQ ID NO: 243 - DNA, 1179 bp, Tupaia chinensis
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttctggtatg

SEQ ID NO: 244 - DNA, 1179 bp, Vombatus ursinus
  misc_feature (463)..(465): n is a, c, g, or t
  misc_feature (1165)..(1167): n is a, c, g, or t
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtnnnttcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtnnngtttctggtatg

SEQ ID NO: 245 - DNA, 1179 bp, Eptesicus fuscus
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtggtgtttctggtatg

SEQ ID NO: 246 - DNA, 1179 bp, Sousa chinensis
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccagctttcatggacccacaattgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttggaatctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttcttctatg

SEQ ID NO: 247 - DNA, 1179 bp, Platysternon megacephalum
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccagctttcatggacccacaattgtctaagttgccaaactgtggtttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttcttctatg

SEQ ID NO: 248 - DNA, 1179 bp, Grammomys surdaster
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacgttgctttcgaagttgaagactgtgactacatcgttcaaaaggctagagaaagaggtgctaagatcgttagagaaccatggttggaacaagacaagttgggtaaggttaagttcgctgttttgcaaacctacggtgacaccacccacaccttggttgaaaagatgaactacaccggtagattcttgccaggtttcgaagctccagctttcatggacccacaattgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacaccgaaccaaacggtgttgtttcttctatg

SEQ ID NO: 249 - DNA, 1179 bp, Monodon monoceros
atgaccacctactctgacaagggtgaaaagccagaatctggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccagctttcatggacccacaattgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccgacatggaaccaaacggtgttgttccaggtatg

SEQ ID NO: 250 - DNA, 1179 bp, Monodon monoceros
atgacctcttactctgacaagggtgaaaagccagaaagaggtagattcttgcacttccactctgttaccttctgggttggtaacgctaagcaagctgcttcttactactgttctaagatcggtttcgaaccattggcttacaagggtttggaaaccggttctagagaagttgtttctcacgttgttaagcaagacaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctatcatcgttagagaaccatggatcgaacaagacaagttcggtaaggttaagttcgctgttttgcaaaccttcggtgacaccacccacaccttggttgaaaagatgaactacaccggttgtttcttgccaggtttcgaagctccaaccttcaccgacccattgttgtctaagttgccaaagtgtggtttggaaatcatcgaccacatcgttggtaaccaaccagaccaagaaatggaatctgcttctcaatggtacatgagaaacttgcaattccacagattctggtctgttgacgacacccaaatccacaccgaatactctgctttgagatctgttgttatggctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagatctttgagagaaagaggtgttgaattcttggctgttccattcacctactacaagcaattgcaagaaaagttgaagtctgctaagatcagagttaaggaatctatcgacgttttggaagaattgaagatcttggttgactacgacgaaaagggttacttgttgcaaatcttcaccaagccaatgcaagacagaccaaccgttttcttggaagttatccaaagaaacaaccaccaaggtttcggtgctggtaacttcaactctttgttcaaggctttcgaagaagaacaagaattgagaggtaacttgaccgacaccgacccaaacggtgttgctttcagattg

SEQ ID NO: 251 - DNA, 1179 bp, Suricata suricatta
atgacctcttactctgacaagggtaagaagccagaaagaggtagattcttgcacttccactctgttaccttctgggttggtaacgctaagcaagctgcttctttctactgttctaagatgggtttcgaaccattggcttacagaggtttggaaaccggttctagagaagttgcttctcacgttatcaagcaaggtcaaatcgttttcgttttctcttctgctttgaacccatggaacaaggaaatgggtgaccacttggttagacacggtgacggtgttaaggacgttgctttcgaagttcaagactgtgactctatcgttcaaaaggctcaagaaagaggtgctaagatcatcagagaaccatgggttgaacaagacaagttcggtaaggttaagttcgctgttttgcaaaccttcggtgacaccacccacaccttggttgaaaagatgaactacagaggtccattcttgccaggtttcatggctagagctccaagagactctttgttgtctaagttgccacaatgtaacttggaagttatcgaccacgttgttggtaaccaaccagaccaagaaatgttgtctgcttctgaatggtacttgaacaacttgcaattccacagattctggtctgttgacgacaaggaattgcacaccgaatactcttctttgagatctatcgttgttaccaactacgaagaatctatcaagatcccaatcaacgaaccagctccaggtagaaagaagtctcaaatccaagaatacgttgactactacggtggtgctggtgttcaacacatcgctttgaagacccaagacatcatcaccaccatcagatctttgaaggaaagaggtatggaattcttgaacaccccaccaacctactacaagcaattgagagaaaagttgaagtctgctaagatcagagttcaagaaaacatggacaccttggaagaattgaagatcttggttgactacgacgaaaacggttacttgttgcaaatcttctctaagccaatgcaagacagaccaaccttgttcttggaagttatccaaagacacaaccaccaaggtttcggtgctggtaacttcaactctttgttcaaggctttggaagaagaacaaaacttgagaggtaacttgaccgacttggaaaccaacggtgttgttccaggtatg

SEQ ID NO: 252 - DNA, 1179 bp, Lynx canadensis
atgacctcttactctaacaagggtgaaaagccagaaagaggtagattcttgcacttccactctgttaccttctgggttggtaacgctaagcaagctgcttctttctactgttctaagatgggtttcaagccaatcgcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacgctggtttcttcttgccaggtttcgaaccaaccaccaacagagaccaagctttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaaaacttggacgctttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacatgagaggtaacttgaccgacttggaaccaaacggtgttatcagaggtatg

SEQ ID NO: 253 - DNA, 1179 bp, Marmota monax
atgacctcttactctaacaagggtgaaaagccagaaagaggtagattcttgcacttccactctgttaccttctgggttggtaacgctaagcaagctgcttctttctactgttctaagatgggtttcaagccaatcgcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacaccggtttcttcttgccaggtttcgaaccaaccaccaacagagacccagctttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaaaacttggacgctttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacatgagaggtaacttgaccgacttggaaccaaacggtgttatcagaggtatg

SEQ ID NO: 254 - DNA, 1179 bp, Nomascus leucogenys
atgacctcttactctaacaagggtgaaaagccagaaagaggtagattcttgcacttccactctgttaccttctgggttggtaacgctaagcaagctgcttctttctactgttctaagatgggtttcaagccaatcgcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacaccggtttcttcttgccaggtttcgaaccaaccaccaacagagacccagttttgtctaagttgccacaatctaacttggaagttatcgaccacatcgttggtaaccaaccagaccaagaaatgttgtctgcttctgctagatacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaatctttggacgctttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacttggaaccaaacggtgttatcagaggtatg

SEQ ID NO: 255 - DNA, 1179 bp, Rhinopithecus roxellana
atgacctcttacaccaacagaggtgaaaagccagaaagaggtagattcttgcacttccactctgttaccttctgggttggtaacgctaagcaagctgcttctttctactgttctaagatgggtttcaagccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacaccggtttcttcttgccaggtttcgaaccaaccaccaacagagacccagctttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaatctttggacgctttggaagaattgagaatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacatggaaaccaacggtgttgttagaggtatg

SEQ ID NO: 256 - DNA, 1179 bp, Muntiacus muntjak
atgacctcttacaccaacaagggtgaaaagccagaaagaggtagattcttgcacttccactctgttaccttctgggttggtaacgctaagcaagctgcttcttactactgttctaagatgggtttcaagccattggcttacagaggtttggaaaccggttctagagaagttgtttctcacgttgttaagcaaggtcaaatcgttttcatcttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatggactacaccggtttgttcttgccaggtttcaacccaaccacccacaccgactctgttttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccagctacctactacagacaattgagagaaaagttgaagtctgctaagatcagagttaaggaatctttggacaccttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacatggaaaccaacggtgttgttagaggtatg

SEQ ID NO: 257 - DNA, 1179 bp, Mastomys coucha
atgacctcttactctaacaagggtgaaaagccagaaagaggtagattcttgcacttccactctgttaccttctgggttggtaacgctaagcaagctgcttctttctactgttctaagatgggtttcaagccattggcttacagaggtttggaaaccggttctagagacgttgtttctcacgttgttaagcaaggtcaaatcgttttcgttttctcttctgctttgaacccatggaacaaggacatgggtgaccacttggttaagcacggtgacggtgttaaggacatcgctttcgaagttgaagactgtgactacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaagtacaccggtttcttcttgccaggtttcgaaccagttgctaagatggacccagctttgtctaagttgccacaatgtaacttggaagttatcgaccacatcgttggtaaccaaccagaccaagaaatggaatctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgaatacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaaaacatcgaaatcttggaagaattgagaatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacatggaaccaaacggtgttttgagaggtatg

SEQ ID NO: 258 - DNA, 1179 bp, Camelus dromedarius
atgacctcttactctaacaagggtccaaagccagaaagaggtagattcgttcacttccactctgttaccttctgggttggtaacgctaagcaagctgcttctttctactgtaccagaatgggtttcgaaccattggcttacagaggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacgttgctttcgaagttgaagactgtgactacatcgttcaaaaggctcaagaaagaggtgctaagatcatcagagaaccatgggttgaacaagacaagttcggtaaggttaagttcgctgttttgcaaacctacggtgacaccacccacaccttggttgaaaagatgtcttacaccggttgtttcttgccaggtttcaagggtttggactctaaggacgctttgttgtctaagttgccacactgttgtttggaagttatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtaagaagaagtctcaaatccaagaatacgttgacttcaacggtggtgctggtgttcaacacatcgctttgaagacccaagacatcatctctgctatcagacacttgagagaaagaggtatggaattcttgcacgttccatctacctactacaagcaattgagagaaaagttgaagtctgctaagatcagagttaaggaaaacatggacgttttggaagaattgaacatcttggttgactacgacgacaagggttacttgttgcaaatcttcaccaagccaatgcaagacagaccaaccttgttcttggaaatcatccaaagacacaaccaccaaggtttcggtgctggtaacttcaacgctttgttcgaagctatcgaagaagaacaagctttgagaggtaacttgaccgacttggaaaccaacggtgttgttcaaggtaag

SEQ ID NO: 259 - DNA, 1179 bp, Papio anubis
atgacctcttactctgacaagggtcaaaagccagaaagaggtagattcttgcacttccactctgttaccttctgggttggtaacgctaagcaagctgcttctttctactgttctaaggttggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatcagagaaccatgggttgaacaagacaagttcggtaaggttaagttggctgttttgcaaacctacggtgacaccacccacaccttggttgaaaagatgaactacaccggttgtttcttgccaggtttcgaagctgttgactgtaaggacccattgttgtctaagttgccacaatgtggtttggaagttgttgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccggtgacatcatctctgctatcagacacttgagagaaagaggtatggaattcttgcacgttccatctacctactacaagcaattgagagaaaagttgaagtctgctaagatcagagttaaggaaaacttggacgttttggaagaattgagaatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagctttgagaggtaacttgaccgacatggaaatcaacggtatcgctagaggtatg

SEQ ID NO: 260 - DNA, 1179 bp, Sarcophilus harrisii
atgacctcttactctaacaagggtgaaaagccagttagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtgaaatcgttttcgttttctcttctgctttgaacccatggcacaaggaaatgggtgaccacttggttaagcacggtgacggtgttaaggacatcgctttcgaagttgaagactgtgactacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaactacaccggtagattcttgccaggtttcgaagctccagttttcaaggacccacaattgtctaagttgccacactgtaagttggaagttatcgaccacatcgttggtaaccaaccagaccaagaaatggtttctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatcaccgctatcagacacttgagagaaagaggtatcgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggacaccaacggtgttatccacggtatg

SEQ ID NO: 261 - DNA, 1179 bp, Crocuta crocuta
atgaccacctactctgacaagggtcaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttgttaagcaaggtgaaatcgttttcgttttctgttctgctttgaacccatggaacaaggaaatgggtgaccacttggttaagcacggtgacggtgttaaggacatcgctttcgaagttgaagactgtgaatacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaactacaccggtagattcttgccaggtttcgaagctccagctttcaccgacccattgttgtctaagttgccacactgtaagttggaaatcatcgaccacatcgttggtaaccaaccagaccaagaaatgacctctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagaagattgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggaaaccaacggtgttatcaccggtatg

SEQ ID NO: 262 - DNA, 1290 bp, Hylobates moloch
atggaattcttgggtgctgctgctgaattggaaatgggttcttgtccaggtgctttgtctaccccagcttcttgtccagttttccaagctggttctttgaccaagatcaacatgaccacctactctgacaagggtcaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttgttaagcaaggtgaaatcgttttcgttttctgttctgctttgaacccatggaacaaggaaatgggtgaccacttggttaagcacggtgacggtgttaaggacatcgctttcgaagttgaagactgtgaatacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaactacaccggtagattcttgccaggtttcgaagctccaaccttcaccgacccattgttgtctaagttgccacactgtaagttggaaatcatcgaccacatcgttggtaaccaaccagaccaagaaatgacctctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagaagattgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggaaaccaacggtgttatcaccggtatg

SEQ ID NO: 263 - DNA, 1236 bp, Sapajus apella
atgtgtagacaacaatctttcttcccaggtggttctttgcacttgagacaacaaggtcaacaagctgaaggtggtcaaggtttgtcttctggttctccaccaggttggccattggacccacacgaaccatgttgtaacccagttatccaagctgtttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggctaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgtctgacttggaaaccaacggtgttgttccaggtatg

SEQ ID NO: 264 - DNA, 1179 bp, Mustela erminea
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagacaagttgtttctcacgttatcaagcaaggtcaaatcgttttcgttttgtcttctgctttgaacccaggtaacaaggaaatgggtgaccacttggttaagcacggtgacggtgttaaggacatcgctttcgaagttgaagactgtgactacatcgttcaaaaggctagagaaagaggtgctaagatcttgagagaaccatgggttgaacaagacaagttcggtaaggttaagttcgctgttttgcaaacctacggtgacaccacccacaccttggttgaaaagatgaactacaccggtagattcttgccaggtttcgaagctccaatgtctaaggacccattgttgtctaagttgccatcttgttctttggaaatcatcgaccacatcgttggtaaccaaccagaacaagaaatggtttctgcttctgaatggtacttgagaaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatctctgctatcagacacttgagagaaagaggtatggaattcttggctgttccagctacctactacaagcaattgagagaaaagttgagatctgctaagatcagagttaccgaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggaaaccaacggtgttgttccaggtatg

SEQ ID NO: 265 - DNA, 1179 bp, Camelus ferus
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcgactacaccggtagattcttgccaggtttcgaagctccaatctacaaggacaccttgttgccaaagttgccaagatgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctatggacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 266 - DNA, 1131 bp, Phocoena sinus; identical to SEQ ID NO: 155

SEQ ID NO: 267 - DNA, 1128 bp, Lontra canadensis
tactgggacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 268 - DNA, 1179 bp, Tyto alba; identical to SEQ ID NO: 149

SEQ ID NO: 269 - DNA, 1179 bp, Trachypithecus francoisi
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggctaagcacggtgacggtgttaaggacatcgctttcgaagttgaagactgtgaatacatcgttcaaaaggctagagaaagaggtgctaagatcgttagagaaccatgggttgaacaagacaagttcggtaaggttaagttcgctgttttgcaaacctacggtgacaccacccacaccttggttgaaaaggttaactacaccggtagattcttgccaggtttcgaagctccaacctacaaggacaacttgttgccaaagttgccaagatgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagatgttgagagaaaacttgaagagagctaagatccaagttaaggaatctttggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagctttgagaggtaacttgaccgacttggaaaccaacggtgttagatctggtatg

SEQ ID NO: 270 - DNA, 1179 bp, Mirounga leonina
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcatcagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaacttgttgccaaagttgtctagatgtaagttggaagttatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagatgttgagagaaaacttgaagatcgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagctttgagaggtaacttgaccgacttggaaaccaacggtgttagatctggtatg

SEQ ID NO: 271 - DNA, 1179 bp, Arvicanthis niloticus
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttctgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctttggacgttttggaagaattgaagatcttggttgactacgacgaaaagggttacttgttgcaaatcttcaccaagccaatgcaagacagaccaaccttgttcttggaagttatccaaagaagaaaccaccaaggtttcggtgctggtaacttcaactctttgttcaaggctttcgaagaagaacaagctttgagaggtaacttgaccgacatggaaaccaacggtgttagatctggtatg

SEQ ID NO: 272 - DNA, 1179 bp, Trachemys scripta elegans
atgaccacctacaacaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgctatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctttggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacatggaaaccaacggtgttagatctggtatg

SEQ ID NO: 273 - DNA, 1179 bp, Pan paniscus
atgacctcttacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagtctgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacatggaaaccaacggtgttagatctggtatg

SEQ ID NO: 274 - DNA, 1179 bp, Callithrix jacchus
atgacctcttacaccaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacgctgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacccacaaggacaccttgttgtctaagttgccatcttgtaacttggaagttatcgaccacatcgttggtaaccaaccagaccaagaaatgacctctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagaggtaacttgaagaccgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 275 - DNA, 1179 bp, Canis lupus dingo
atgacctcttacaccaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaatgcacaaggacaccttgttgtctaagttgccatcttgtaacttggaagttatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacagattgttgagagaaaacttgaagaccgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 276 - DNA, 1179 bp, Rhinolophus ferrumequinum
atgaccacctacaccaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtcacttcttgccaggtttcgaagctccagtttacaaggacaccttgttgccaaagttgccaagatgtaacttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgacgacatcatcaccgctatccaccacttgagagaaagaggtatggaattcttggctgttccatcttcttactacaagttgttgagagaaaacttgaagaccgctaagatccaagttaaggaatctatggacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtaag

SEQ ID NO: 277 - DNA, 1179 bp, Rhinolophus ferrumequinum
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccagtttacaaggacaccttgttgccaaagttgccaagatgtaacttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgacgacatcatcaccgctatcagacacttgagagaaagaggtatggaattcttggctgttccatcttcttactacaagttgttgagagaaaacttgaagaccgctaagatccaagttaaggaatctttggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 278 - DNA, 1179 bp, Phyllostomus discolor
atgaccacctacaacaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaatctcacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 279 - DNA, 1179 bp, Halichoerus grypus
atgaccacctacaacaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 280 - DNA, 1179 bp, Onychomys torridus
atgaccacctacaacaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagagaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 281 - DNA, 1137 bp, Rousettus aegyptiacus
accgttgactactgggacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtaaccacatcgttcaaaaggctagagaaagaggtgctaagatcgttagagacgcttgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 282 - DNA, 1179 bp, Molossus molossus
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacgttgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaatctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatcgaattcttggctgttccatcttcttactacaagttgttgagagaaaacttgaagtctgctaagatccaagttaaggaaaacatggacatcttggaagaattgcaaatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 283 - DNA, 1179 bp, Myotis myotis
atgaccacctactctaacagaggtccaaagccagaaagaggtcaattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccagcttacaaggacatcttgttgtctaagttgccaaactgtcacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctatgaacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaacaagaacaagctttgagaggtaacttgaccgacttggaaaccaacggtgttagatctggtatg

SEQ ID NO: 284 - DNA, 1179 bp, Pipistrellus kuhlii
atgaccacctactctaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtaaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttgtttcttgccaggtttcgaagctccaacctacaaggacccattgttgtctaagttgccaaactgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtatggaattcttggctgttccatcttcttactacaagttgttgagagaaaacttgaagaccgctagaatccaagttaaggaatctatcgacgttttggaagaattgaagatcttggttgactacgacgacaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacaccggtaccaacagagttatgtctggtatg

SEQ ID NO: 285 - DNA, 1179 bp, Balaenoptera musculus
atgaccacctactctgacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacagattcggtaaggttaagttcgctgttttgcaaacctacggtgacaccacccacaccttggttgaaaagatcaactacaccggtagattcttgccaggtttcgaagctccaatgttgaaggacccattgttgtctaagttgccaaactgttctttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccaccatcagacacttgagagaaagaggtatggaattcttggctgttccatctacctactacaagttgttgagagaaaacttgaagtctgctaagatcagagttaaggaatctatcgacgttttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacatggaaaccaacggtgttgtttctggtatg

SEQ ID NO: 286 - DNA, 1260 bp, Manis pentadactyla
atgagaccaagattggaccaaaagttgccaggtttgggtccatgtagaccaagattgtcttctagaccacacgaaggtcaccaaaccacctactctaacaagggtccaaagccagaaagaggtagattcttgcacttccactctgttaccttctgggttggtaacgctaagcaagctgcttctttctactgtaacaagatgggtttcgaaccattcgcttacagaggtttggaaaccggtgctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactctatcgttcaaaaggctagagaaagaggtgctaagatcgttagagaaccatgggttgaacaagacaagttcggtaaggttaagttcgctgttttgcaaacctacggtgacaccacccacaccttggttgaaaaggttaactacaccggtagattcttgccaggtttcgaagctccagttatgaccgacccattgttgtctaagttgccaaactgtcacttggaaatcatcgaccacatcgttggtaaccaaccagaccaagaaatggtttctgcttctgaatggtacttgaagaacttgcaattccacagattctggtctgttgacgacaagcaagttcacaccgaatactcttctttgagatctgttgttgttgctaactacgaagaatctatcaagatgccaatcaacgaaccagctccaggtaagaagaagtctcaaatccaagaattcgttgaatacaacggtggtgctggtgttcaacacatcgctttgaagacccaagacatcatcacctctatcagacacttgagagaaagaggtaccgaattcttggctgttccatctacctactacaagcaaatcagagaaaagttgaagaccgctaagatcaaggttaaggaaaacatcgacatcttggaagaattgagaatcttggttgactacgacgaaaagggttacttgttgcaaatcttcaccaagccaatgcaagacagaccaaccttgttcttggaaatcatccaaagacacaaccaccaaggtttcggtgctggtaacttcaacgctttgttcaaggctttcgaagaagaacaagacttgagaggtaacttgatcgacgttaacaccaacggtgttgttccaggtatg

SEQ ID NO: 287 - DNA, 1179 bp, Manis javanica
atgaccacctactctgacaagggtcaaaagccagaaaagggtagattcttgcacttccactctgttaccttctgggttggtaacgctaagcaagctgcttctttctactgttctaagatgggtttcgaaccattggcttacaagggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttcaagaaccatgggttgaacaagacaagttcggtaaggttaagttcgctgttttgcaaacctacggtgacaccacccacaccttggttgaaaagatgaactacaccggtagattcttgccaggtttcgaagctccaaccttcaaggacccattgttgtctaagttgccaaactgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcgctgctatcagacacttgagagaaagaggtatggaattcttggctgttccaccaacctactacaagcaattgagagaaaacttgaagttggctaagatccaagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaagctaacggtatggtttctggtatg

SEQ ID NO: 288 - DNA, 1179 bp, Sturnira hondurensis
atgaccacctactctgacaagggtgctaagccacaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttatcagacaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaaaaggacaagttcggtaaggttaagttcgctgttttgcaaacctacggtgacaccacccacaccttggttgaaaagatgaactacaccggtagattcttgccaggtttcgaagctccaacctacgttgacccacacttggctaagttgccagactgtaacttggaaatcatcgaccacatcgttggtaaccaaccagaccaagaaatggtttctgcttctgaatggtacttgagaaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccacgacatcatcaccgctatcagacacttgagagaaagaggtatggaattcttggctgttccatctacctactacagacaattgagagaaggtttgaagtctgctaagatccaagttaaggaatctatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttgctttgggtatg

SEQ ID NO: 289 - DNA, 1173 bp, Talpa occidentalis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccaaccttcaaggacccattgttgtctaagttgccaaagtgttctttggaaatcatcgaccacatcgttggtaaccaaccagaccaagaaatggttccagcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcatggctatcagacacttgagagaaagaggtatggaattcttggctgttccatctacctactacagacaattgagagaaaacttgaagaccgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagaagaaaccaccaaggtttcggtgctggtaacttcaactctttgttcaaggctttcgaagaagaacaagacttgagaggtaacttgaccgacttggaaccaaacggtgttgtttct

SEQ ID NO: 290 - DNA, 1179 bp, Choloepus didactylus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacaccggtagattcttgccaggtttcgaagctccaaccttcatggacccattgttgtctaagttgccatcttgtaccttggaaatcatcgaccacatcgttggtaaccaaccagaccaagaaatgttgtctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaaggctatcagacacttgagagaaagaggtatggaattcttggctgttccatctgcttactacagacaattgagagaaaacttgaagaccgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacgttgaaaccaacggtttggttagaggtatg

SEQ ID NO: 291 - DNA, 1179 bp, Chlorocebus sabaeus
atgaccacctactctgacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgcttctcacgttatcaagcaaggtcaaatcgttttcgttttgtcttctccattgaacccatggaacagagaaatgggtgaacacttggttaagcacggtgactctgttaaggacatcgctttcgaagttgaagactgtgactacatcgttcaaaaggctagagaaagaggtgctaaggttgttagagaaccatgggttgaagaagacaagttcggtaaggttaagttggctgttttgcaaacctacggtgacaccacccacaccttggttgaaaagatgtctttctctggttctttcttgccaggtttcgaagctccaagagttaaggactctttgttgtctaagttgccatcttgtggtttggaaaccatcgaccacatcgttggtaaccaaccagaccaagaaatggtttctgcttctgaatggtacttgagaaacttgcaattccacagattctggtctgttgacgactctcaagttcacaccgaatactctgctttgagatctatcgttgttaccaactacgaagaatctatcaagatgccaatcaacgaaccagctttgggtagaaagaagtctcaaatccaagaatacgttgaatacaacggtggtgctggtgttcaacacatcgctttgaagaccccagacatcatcacctctatcagacacttgagagaaagaggtgttgaattcttggctgttccatctacctactacaagcaattgagagaaaacttgaagtctgctaagatcagagttaaggaatctatcgacatgttggaagaattgaagatcttggttgactacgacgaaaagggttacttgttgcaagttttcaccaagccagttcaagacagaccaaccttgttcttggaagttatccaaagacacaaccaccaaggtttcggtgctggtaacttcaacgctttgttcaaggctttcgaagctgaacaagacttgagaggtaacttgaccgacaccgaaaccaacggtgttgtttctggtgtt

SEQ ID NO: 292 - DNA, 1179 bp, Chlorocebus sabaeus
atgaccacctactctgacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgcttctcacgttatcaagcaaggtcaaatcgttttcgttttgtcttctccattgaacccatggaacagagaaatgggtgaacacttggctaagcacggtgactctgttaaggacatcggtttcgaagttgaagactgtgactacatcgttcaaaaggctagagaaagaggtgctaaggttgttagagaaccatgggttgaacaagacaagttcggtaaggttaagttcgctgttttgcaaacctacggtgacaccacccacaccttggttgaaaaggttaactactctggttctttcttgccaggtttcgaagctccaagagctaaggacccattgttggctaagttgccatcttgttctttggaaatgatcgaccacatcgttggtaaccaaccagaccaagaaatggtttctgcttctgaatggtacttgagatctttgcaattccacagattctggtctgttgacgacacccaagttcacaccgaatactcttctttgagatctatcgttgttaccaactacgaagaatctatcaagatgccaatcaacgaaccagctccaggtaagaagaagtctcaaatccaagaatacgttgactacaacggtggtgctggtgttcaacacatcgctttgggtacccaagacatcatcacctctatcagacacttgagagaaagaggtgttgaattcttggctgttccatctacctactacaagcaattgagagaaaacttgaagtctgctaaggttcaagttaaggaatctatcgacatgttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaacgctttgttcaaggctttcgaagctgaacaagacttgagaggtaacttgaccgacgttgaaaccaacggtgttgaatctggtttg

SEQ ID NO: 293 - DNA, 1230 bp, Arvicola amphibius
atgccatggccaccaggtaccgtttcttgggaagctagaccaagaccagctatgaccacctactctgacaagggtgaaaagccagaaagaggtagattcttgcacttccactctgttaccttctgggttggtaacgctaagcaagctgctgctttctactgttctaagatgggtttcgaaccattggcttacagaggtttggaaaccggttctagagaagttgcttctcacgttatcaagcaaggtcaaatcgttttcgttttctcttctccattgaacccaggtaacaaggaattgggtgaccacttggttaagcacggtgacggtgttaaggacatcgctttcgaagttgaagactgtgactacatcgttcaaaaggctagagaaagaggtgctaaggttgttagagaaccatgggttgaacaagacagattcggtaaggttaagttcgctgttttgcaaacctacggtgacaccacccacaccttggttgaaaagaccggttacaccggttctttcttgccaggtttcgaagctccaagagttaaggactctttgttgtctaagttgccaaactgtggtttggaaatcatcgaccacgttgttggtaaccaaccagaccaagaaatgttgtctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtgctgaattcttggctgttccatctacctactacaagcaattgagagaaaacttgaagtctgctaaggttcaagttaaggaaaacatcgacatgttggaagaattgagaatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagctgaacaagacttgagaggtaacttgaccgacttggaaccaaacggtgttgcttctggtatg

SEQ ID NO: 294 - DNA, 1179 bp, Tachyglossus aculeatus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgcttctcacgttatcaagcaaggtcaaatcgttttcgttttctcttctccattgaacccatggaacaaggaaatgggtgaccacttggttaagcacggtgacggtgttaaggacatcgctttcgaagttgaagactgtgactacatcgttcaaaaggctagagaaagaggtgctaaggttgttagagaaccatgggttgaacaagacaagtctggtaaggttaagttcgctgttttgcaaacctacggtgacaccacccacaccttggttgaaaagaccggttactctggttctttcttgccaggtttcgaagctgctagagctaaggactctttgttgtctaagttgccatcttgtggtttggaaatcatcgaccacatcgttggtaaccaaccagaccaagaaatgttgtctgcttctgaatggtacttgagaaacttgcaattccacagattctggtctgttgacgacacccaagttcacaccgaatactcttctttgagatctatcgttgttaccgactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtgctgaattcttggctgttccatcttcttactacacccaattgagagaaaacttgaagtctgctaaggttagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagctgaacaagacttgagaggtaacttgaccgacttggaaaccaacggtgttgcttctggtatg

SEQ ID NO: 295 - DNA, 1179 bp, Canis lupus familiaris
atgaccacctactctgacaagggtgctaagccagaaagaggtagattcttgcacttccactctgttaccttctgggttggtaacgctaagcaagctgctgcttactactgttctaagatgggtttcgaattgttggcttacagaggtttggaaaccggttctagagaagttgcttctcacgttatcaagcaaggtcaaatcgttttcgttttctcttctccattgaacccatggaacaaggaaatgggtgaccacttggttaagcacggtgacggtgttaaggacatcgctttcgaagttcaagactgtgactacatcgttcaaaaggctagagaaagaggtgctaaggttgttagagaaccatgggttgaacaagacaagttcggtaaggttaagttcgctgttttgcaaacctacggtgacaccacccacaccttggttgaaaagatgtcttacaccggttctttcttgccaggtttcgaagctccaagagttaaggacgctttgttgttcaagttgccatcttgtggtttggaaatcatcgaccacatcgttggtaaccaaccagaccaagaaatggcttctgcttctgaatggtacttgagaaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtgctgaattcttggctgttccatcttcttactacagacaattgagagaaaacttgaagtctgctaaggttagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagctgaacaagacttgagaggtaacttgaccgacttggaaaccaacggtgaagtttctggtatg

SEQ ID NO: 296 - DNA, 1182 bp, Eschrichtius robustus
atgaccacctactctgacaagggtgttaagccagaaagaggtagattcttgcacttccactctgttaccttctgggttggtaacgctaagcaagctgcttctttctactgttctaagatgggtttcaagccattggcttacagaggtttggaaaccggttctagagaagttgtttctcacgttatcaagcacggtaagatcgttttcgttttgtcttctgctttgaacccatggaacaaggaaatgggtgaccacttggttaagcacggtgacggtgttaaggacatcgctttcgaagttgaagactgtaactacatcgttcaaaaggctagagaaagaggtgctaagatcgttagagaaccatgggttgaacaagacaagtgtggtagagttaagttcgctgttttgcaaacctacggtgacaccacccacaccttggttgaaaagatcaactacaccggttgtttcttgccaggtttcgaagctccaaccttcatggacccattgttgtctaagttgccatcttgtaacttggaaatcatcgaccacatcgttggtaaccaaccagaccaagaaatggcttctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtaagaagaagtctcaaatccaagaatacgttgactacaacggtggtgctggtgttcaacacatcgctttgagaacccaagacatcatcaccgctatcagacacttgaaggaaagaggtatggaattcttggctgttccatctacctactacaagcaattgagagaaaagttgaagtctgctaaggttcaagttaaggaatctatcgacgttttggaagaattgaagatcttggttgactacgacgaaaagggttacttgttgcaaatcttcaccaagccagttcaagacagaccaaccttgttcttggaagttatccaaagaaacaaccaccaaggtttcggtgctggtaacttcaactctttgttcaaggctttcgaagaagaacaaaacttgagaggtaacttgaccgacttggaatctaaccaaccaggtagagctagacac

SEQ ID NO: 297 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 298 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFAQLKKYNRTSAVDFGNIDIVKYAESFGATGLRVESPDQLADVLRQGMNAEGPVIIDVPVDYSDNINLASDKLPKEFGELMKTKAL

SEQ ID NO: 299 - protein, 561 aa, Trichoderma atroviride
MTKDTVDILIDSLKAAGVKYVFGVPGAKIDSVFNALIDHPDIKLVVCRHEQNAAFIAAAMGKVTGRPGVCIATSGPGTSNLVTGLVTATDEGAPVVAIVGSVKRSQSLQRTHQSLRGADLLAPVTKKVVSAVVEDQVAEIMLDAFRVAAASPPGATAVSLPIDLMTPAKSTSTVTAFPAECFIPPKYGKSPETTLQAAADLISAAKAPVLFLGMRVSESDDTISAVHGFLRKHPVPVVETFQAAGAISKELVHLFYGRIGLFSNQPGDQLLQHADLVIAIGLDQAEYDANMWNARGTTILHVDIQPADFVAHYKPKIELVGSLADNMTDLTSRLDTVARLQLTKPGEAIRTNMWEWQNSPEASGRSTGPVHPLHFIRLFQSIIDPSTTVISDVGSVYIWLCRYFYSYARRTFLMSNVQQTLGVAMPWAIGVSLSQTPPSSKKVVSISGDGGFMFSSQELVTAVQQGCNITHFIWNDGKYNMVEFQEVNKYGRSSGVDLGGVDFVKLADSMGAKGLRVSSAGDLEAVMKEALAYDGVCLVDIEIDYSQNHNLMMDLVTSDVS

SEQ ID NO: 300 - protein, 687 aa, Saccharomyces cerevisiae [sequence omitted]

SEQ ID NO: 301 - protein, 491 aa, Escherichia coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 302 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 303 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 304 - protein, 570 aa, Lactococcus lactis
MEFKYNGKVESVELNKYSKTLTQDPTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFESLGQKITGNISDEDYHGVICNAIPGQGACGGMYTANTLAAAIETLGMSLPYSSSNPAVSQEKQEECDEIGLAIKNLLEKDIKPSDIMTKEAFENAITIVMVLGGSTNAVLHIIAMANAIGVEITQDDFQRISDITPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSDEEIAKRRANYQKPTPKATRGVLAKFAKLTRPASEGCVTDL

SEQ ID NO: 305 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 306 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 307 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 308 - protein, 616 aa, Corynebacterium glutamicum
MSPNDAFISAPAKIETPVGPRNEGQPAWNKQRGSSMPVNRYMPFEVEVEDISLPDRTWPDKKITVAPQWCAVDLRDGNQALIDPMSPERKRRMFELLVQMGFKEIEVGFPSASQTDFDFVREIIEKGMIPDDVTIQVLVQAREHLIRRTFEACEGAKNVIVHFYNSTSILQRNVVFRMDKVQVKKLATDAAELIKTIAQDYPDTNWRWQYSPESFTGTEVEYAKEVVDAVVEVMDPTPENPMIINLPSTVEMITPNVYADSIEWMHRNLNRRDSIILSLHPHNDRGTGVGAAELGYMAGADRIEGCLFGNGERTGNVCLVTLALNMLTQGVDPQLDFTDIRQIRSTVEYCNQLRVPERHPYGGDLVFTAFSGSHQDAVNKGLDAMAAKVQPGASSTEVSWEQLRDTEWEVPYLPIDPKDVGRDYEAVIRVNSQSGKGGVAYIMKTDHGLQIPRSMQVEFSTVVQNVTDAEGGEVNSKAMWDIFATEYLERTAPVEQIALRVENAQTENEDASITAELIHNGKDVTVDGHGNDPLAAYANALEKLGIDVEIQEYNQHARTSGDDAEAAAYVLAEVNGRKVWGVGIAGSITYASLKAVTSAVNRALDVNHEAVLAGGV

SEQ ID NO: 309 - protein, 616 aa, Corynebacterium glutamicum
MSPNDAFISAPAKIETPVGPRNEGQPAWNKQRGSSMPVNRYMPFEVEVEDISLPDRTWPDKKITVAPQWCAVDLRDGNQALIDPMSPERKRRMFELLVQMGFKEIEVGFPSASQTDFDFVREIIEKDMIPDDVTIQVLVQAREHLIRRTFEACEGAKNVIVHFYNSTSILQRNVVFRMDKVQVKKLATDAAELIKTVAQDYPDTNWRWQYSPESFTGTEVEYAKEVVDAVVEVMDPTPENPMIINLPSTVEMITPNVYADSIEWMHRNLNRRDSIILSLHPHNDRGTGVGAAELGYMAGADRIEGCLFGNGERTGNVCLVTLALNMLTQGVDPQLDFTDIRQIRSTVEYCNQLRVPERHPYGGDLVFTAFSGSHQDAVNKGLDAMAAKVQPGASSTEVSWEQLRDTEWEVPYLPIDPKDVGRDYEAVIRVNSQSGKGGVAYIMKTDHGLQIPRSMQVEFSTVVQNVTDAEGGEVNSKAMWDIFATEYLERTAPVEQIALRVENAQTENEDASITAELIHNGKDVTVDGHGNGPLAAYANALEKLGIDVEIQEYNQHARTSDDDAEAAAYVLAEVNGRKVWGVGIAGSITYASLKAVTSAVNRALDVNHEAVLAGGV

SEQ ID NO: 310 - protein, 616 aa, Corynebacterium glutamicum
MSPNDAFISAPAKIETPVGPRNEGQPAWNKQRGSSMPVNRYMPFEVEVEDISLPDRTWPDKKITVAPQWCAVDLRDGNQALIDPMSPERKRRMFELLVQMGFKEIEVGFPSASQTDFDFVREIIEKGMIPDDVTIQVLVQAREHLIRRTFEACEGAKNVIVHFYNSTSILQRNVVFRMDKVQVKKLATDAAELIKTIAQDYPDTNWRWQYSPESFTGTEVEYAKEVVDAVVEVMDPTPENPMIINLPSTVEMITPNVYADSIEWMHRNLNRRDSIILSLHPHNDRGTGVGAAELGYMAGADRIEGCLFGNGERTGNVCLVTLALNMLTQGVDPQLDFTDIRQIRSTVEYCNQLRVPERHPYGGDLVFTAFSGSHQDAVNKGLDAMAAKVQPGASSTEVSWEQLRDTEWEVPYLPIDPKDVGRDYEAVIRVNSQSGKGGVAYIMKTDHGLQIPRSMQVEFSTVVQNVTDAEGGEVNSKAMWDIFATEYLERTAPVEQIALRVENAQTENEDASITAELIHNGKDVTVDGRGNGPLAAYANALEKLGIDVEIQEDNQHARTSGDDAEAAAYVLAEVNGRKVWGVGIAGSITYASLKAVTSAVNRALDVNHEAVLAGGV

SEQ ID NO: 311 - protein, 616 aa, Corynebacterium glutamicum
MSPNDAFISAPAKIETPVGPRNEGQPAWNKQRGSSMPVNRYMPFEVEVEDISLPDRTWPDKKITVAPQWCAVDLRDGNQALIDPMSPERKRRMFELLVQMGFKEIEVGFPSASQTDFDFVREIIEKDMIPDDVTIQVLVQAREHLIRRTFEACEGAKNVIVHFYNSTSILQRNVVFRMDKVQVKKLATDAAELIKTVAQDYPDTNWRWQYSPESFTGTEVEYAKEVVDAVVEVMDPTPENPMIINLPSTVEMITPNVYADSIEWMHRNLNRRDSIILSLHPHNDRGTGVGAAELGYMAGADRIEGCLFGNGERTGNVCLVTLALNMLTQGVDPQLDFTDIRQIRSTVEYCNQLRVPERHPYGGDLVFTAFSGSHQDAVNKGLDAMAAKVQPGASSTEVSWEQLRDTEWEVPYLPIDPKDVGRDYEAVIRVNSQSGKGGVAYIMKTDHGLQIPRSMQVEFSTVVQNVTDAEGGEVNSKAMWDIFATEYLERTAPVEQIALRVENAQTENEDASITAELIHNGKDVTVDGHGNGPLAAYANALEKLGIDVEIQEYNQHAHTSDDDAEAAAYVLAEVNGRKVWGVGIAGSITYASLKAVTSAVNRALDVNHEAVLAGGV

SEQ ID NO: 312 - protein, 523 aa, Escherichia coli
MSQQVIIFDTTLRDGEQALQASLSVKEKLQIALALERMGVDVMEVGFPVSSPGDFESVQTIARQVKNSRVCALARCVEKDIDVAAESLKVAEAFRIHTFIATSPMHIATKLRSTLDEVIERAIYMVKRARNYTDDVEFSCEDAGRTPIADLARVVEAAINAGATTINIPDTVGYTMPFEFAGIISGLYERVPNIDKAIISVHTHDDLGLAVGNSLAAVHAGARQVEGAMNGIGERAGNCSLEEVIMAIKVRKDILNVHTAINHQEIWRTSQLVSQICNMPIPANKAIVGSGAFAHSSGIHQDGVLKNRENYEIMTPESIGLNQIQLNLTSRSGRAAVKHRMDEMGYKESEYNLDNLYDAFLKLADKKGQVFDYDLEALAFIGKQQEEPEHFRLDYFSVQSGSNDIATAAVKLACGEEVKAEAANGNGPVDAVYQAINRITEYNVELVKYSLTAKGHGKDALDQVDIVANYNGRRFHGVGLATDIVESSAKAMVHVLNNIWRAAEVEKELQRKAQHNENNKETV

SEQ ID NO: 313 - protein, 619 aa, Saccharomyces cerevisiae
MVKESIIALAEHAASRASRVIPPVKLAYKNMLKDPSSKYKPFNAPKLSNRKWPDNRITRAPRWLSTDLRDGNQSLPDPMSVEQKKEYFHKLVNIGFKEIEVSFPSASQTDFDFTRYAVENAPDDVSIQCLVQSREHLIKRTVEALTGAKKATIHTYLATSDMFREIVFNMSREEAISKAVEATKLVRKLTKDDPSQQATRWSYEFSPECFSDTPGEFAVEICEAVKKAWEPTEENPIIFNLPATVEVASPNVYADQIEYFATHITEREKVCISTHCHNDRGCGVAATELGMLAGADRVEGCLFGNGERTGNVDLVTVAMNMYTQGVSPNLDFSDLTSVLDVVERCNKIPVSQRAPYGGDLVVCAFSGSHQDAIKKGFNLQNKKRAQGETQWRIPYLPLDPKDIGRDYEAVIRVNSQSGKGGAAWVILRSLGLDLPRNMQIEFSSAVQDHADSLGRELKSDEISKLFKEAYNYNDEQYQAISLVNYNVEKFGTERRVFTGQVKVGDQIVDIEGTGNGPISSLVDALSNLLNVRFAVANYTEHSLGSGSSTQAASYIHLSYRRNADNEKAYKWGVGVSEDVGDSSVRAIFATINNIIHSGDVSIPSLAEVEGKNAAASGSA

SEQ ID NO: 314 - protein, 779 aa, Saccharomyces cerevisiae
MVYTPSKGPRTLYDKVFDAHVVHQDENGSFLLYIDRHLVHEVTSPQAFEGLENAGRKVRRVDCTLATVDHNIPTESRKNFKSLDTFIKQTDSRLQVKTLENNVKQFGVPYFGMSDARQGIVHTIGPEEGFTLPGTTVVCGDSHTSTHGAFGSLAFGIGTSEVEHVLATQTIIQAKSKNMRITVNGKLSPGITSKDLILYIIGLIGTAGGTGCVIEFAGEAIEALSMEARMSMCNMAIEAGARAGMIKPDETTFQYTKGRPLAPKGAEWEKAVAYWKTLKTDEGAKFDHEINIEAVDVIPTITWGTSPQDALPITGSVPDPKNVTDPIKKSGMERALAYMGLEPNTPLKSIKVDKVFIGSCTNGRIEDLRSAAAVVRGQKLASNIKLAMVVPGSGLVKKQAEAEGLDKIFQEAGFEWREAGCSICLGMNPDILDAYERCASTSNRNFEGRQGALSRTHLMSPAMAAAAGIAGHFVDIREFEYKDQDQSSPKVEVTSEDEKELESAAYDHAEPVQPEDAPQDIANDELKDIPVKSDDTPAKPSSSGMKPFLTLEGISAPLDKANVDTDAIIPKQFLKTIKRTGLKKGLFYEWRFRKDDQGKDQETDFVLNVEPWREAEILVVTGDNFGCGSSREHAPWALKDFGIKSIIAPSYGDIFYNNSFKNGLLPIRLDQQIIIDKLIPIANKGGKLCVDLPNQKILDSDGNVLVDHFEIEPFRKHCLVNGLDDIGITLQKEEYISRYEALRREKYSFLEGGSKLLKFDNVPKRKAVTTTFDKVHQDW

SEQ ID NO: 315 - protein, 764 aa, Pichia kudriavzevii
MSTLYDKVFADHVVHTDESGSTLIYIDRHLVHEVTSPQAFEGLTTAGRSVRRPDCTLVTVDHNIPTISRKNFKNVSTFIEQEDSRLQVETLEQNVKDFNLAYFGMSDDRQGIVHVVGPEQGFTLPGTTVVCGDSHTSTHGAFGALAFGIGTSEVEHVLATQTLIQAKSKNMLIRIDGDLKPGITSKDLVLHVIGVIGTAGGTGSVIEFAGKAIRDLSMEARMSICNMAIEAGARAGMIAPDQITFDYIKGRPLAPQGEEWEKAVKYWKTLYSDENAKFDKEVIIKAEDIVPTITWGNSPQDALPITGKVPDPKDFKDDITRSGVEAALEYMGLTANTPLQEIPIDKVFIGSCTNSRIEDLREAAKVVIGHKKAENVKLALVVPGSGLVKKQAEKEGLDKIFQAAGFEWREAGCSMCLGMNPDILDPHERCASTSNRNFRGRQGALSRTHLMSPAMAAAAGIVGHFTDIRNFKYNTSDAPQVQLSSGNEEEDKELQDALYEHEKEPIQTVDSSEEINDIPPNPANEPETAAVGGIEKFTILKSVAAPMERANIDTDAIIPKQFLKTIKRTGLSKGLFYESRFVKDAQGNDVATDFVLNVAPFNKANIIVCTGDNFGCGSSREHAPWALKDFGIKSIIAPSFGDIFYNNSFKNGLLPIRLPQSIIQEKIYPIAKAEKEITVDLVNQQIRGPDDEVLVEHFDVEPFRKHCLVNGLDDIGITLTKSKFIDEFEALRKNKFSFIEMGSRKYIPVKGAKKSPYGNTAQEW

SEQ ID NO: 316 - protein, 340 aa, Corynebacterium glutamicum
MKLAVIGGDGIGPEVTAEALKVLNAVRDDIETTDYDLGARRYLKNGELLTDEDLASLREHDAILLGAIGAPGSVPPGILERGLLLKMRFALDHHVNLRPSKLYDGVESPLRNPGKIDFVVVREGTEGAYTGNGGAIRVGTPHEIANETSVNTRYGAERVIRYAFELAQSRRKKLTLVHKTNVLVHGGGLWQRTVDEVAKEYPEVAVDYNHIDAATIYLVTDPSRFDVIVTDNLFGDILTDEAGAVSGGIGLAASGNIDATGTNPSMFEPVHGSAPDIAGQGIADPTAAILSAAMLLRHLGDEDNAVRIETAIAADVAGRDNSQPISTTEVGDRIVKALQS

SEQ ID NO: 317 - protein, 364 aa, Saccharomyces cerevisiae
MSAPKKIVVLPGDHVGQEITAEAIKVLKAISDVRSNVKFDFENHLIGGAAIDATGVPLPDEALEASKKADAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 318 - protein, 364 aa, Saccharomyces cerevisiae
MSAPKKIVVLPGDHVGQEITAEAIKVLKAISDVRSNVKFDFENHLIGGAAIDATGVPLPDEALEASKKADAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKRPTHLNGIIITSNMFGDIISDEASVIPGSLGLLPSASLASLPDKNTAFGLYEPCHGSAPKYPKNKVNPIATILSAAMMLKLSLNLPEEGKAIEDAVKKVLDAGIRTGDLGGSNSTTEVGDAVAEEVKKILA

SEQ ID NO: 319 - protein, 363 aa, Escherichia coli
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAACAIERAINRALEEGIRTGDLARGAAAVSTDEMGDIIARYVAEGV

SEQ ID NO: 320 - protein, 373 aa, Arabidopsis thaliana
MAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 321 - DNA, 38 bp, Synthetic primer
gacctcgcgttaaccctcttgtgtccacccttcataag

SEQ ID NO: 322 - DNA, 39 bp, Synthetic primer
ccttcctcaaattgctgtggaagagggtctctcaccatg

SEQ ID NO: 323 - DNA, 41 bp, Synthetic primer
gaccctcttccacagcaatttgaggaaggaataggagaagg

SEQ ID NO: 324 - DNA, 30 bp, Synthetic primer
tgtgtttgtttgtgtgttttgtgtgttttg

SEQ ID NO: 325 - DNA, 53 bp, Synthetic primer
gtatagcatacattatacgaagttatcatgtatgcatggctggctatattttg

SEQ ID NO: 326 - DNA, 42 bp, Synthetic primer
catgataacttcgtataatgtatgctatacgaacggtattgc

SEQ ID NO: 327 - DNA, 25 bp, Synthetic primer
catggcttgaattacattttcaagg

SEQ ID NO: 328 - DNA, 19 bp, Synthetic primer
gccggtatcgtccttcttg

SEQ ID NO: 329 - DNA, 27 bp, Synthetic primer
cctctaaagggccacaattttttaatc

SEQ ID NO: 330 - DNA, 21 bp, Synthetic primer
cattgatgttgccgttgcagc

SEQ ID NO: 331 - DNA, 25 bp, Synthetic primer
ggtgcagtaacgaggtagtttaacc

SEQ ID NO: 332 - DNA, 25 bp, Synthetic primer
cgatggcgtcatacaaagaaagatc

SEQ ID NO: 333 - DNA, 24 bp, Synthetic primer
gccaccaggatagaattggatgag

SEQ ID NO: 334 - DNA, 26 bp, Synthetic primer
ccatcgttttattggattcttatagg

SEQ ID NO: 335 - protein, 393 aa, Artificial Sequence
  Engineered protein
MTTYSNKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSPIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKALEEEQALRGNLTDLETNGVRSGM

What is claimed is:

1. A non-natural microorganism capable of producing beta-hydroxyisovalerate (βHIV), wherein the non-natural microorganism comprises a non-natural enzyme, wherein the non-natural enzyme has been modified or mutated to inncrease the ability of the enzyme to preferentially utilize α-ketoisocaproate as its substrate, and wherein the non-natural enzyme comprises one or more modifications or mutations at substrate-specificity positions corresponding to amino acids selected from N187, W210, V212, V217, L224, S226, I227, V228, P239, N241, Q251, I252, Q265, L289, L323, F336, F347, A361, G362, N363, F364, L367, F368, and F371, of any of SEQ ID NO: 1 or SEQ ID NO: 6, and wherein the non-natural microorganism has been modified or mutated to provide more βHIV than its wild-type parent.

2. The non-natural microorganism of claim 1, wherein the non-natural microorganism comprises a metabolic pathway for producing βHIV.

3. The non-natural microorganism of claim 2, wherein the metabolic pathway comprises one or more steps of (i) pyruvate to acetolactate, (ii) acetolactate to 2,3-dihydroxy-isovalerate, (iii) 2,3-dihydroxyisovalerate to α-ketoisovalerate, (iv) α-ketoisovalerate to α-isopropylmalate, (v) α-isopropylmalate to β-isopropylmalate, (vi) β-isopropylmalate to α-ketoisocaproate and (vii) α-ketoisocaproate to βHIV.

4. The non-natural microorganism of claim 2, wherein the metabolic pathway comprises one or more steps of (i) pyruvate into acetolactate, (ii) acetolactate into 2,3-dihydroxyisovalerate, (iii) 2,3-dihydroxyisovalerate into α-ketoisovalerate, (iv) α-ketoisovalerate into 2-isopropylmalate, (v) 2-isopropylmalate into 2-isopropylmaleate, (vi) 2-isopropylmaleate into 3-isopropylmalate, (vii) 3-isopropylmalate into 2-isopropyl-3-oxosuccinate, (viii) 2-isopropyl-3-oxosuccinate into α-ketoisocaproate, and (ix) α-ketoisocaproate into βHIV.

5. The non-natural microorganism of claim 2, wherein the non-natural microorganism is a eukaryote, and wherein the metabolic pathway hosts at least one βHIV pathway enzyme selected from the group consisting of acetolactate synthase having at least 80% identity to the group consisting of SEQ ID NOs: 297-300, cytosolic keto-acid reductoisomerase having at least 80% identity to the group consisting of SEQ ID NOs: 301-303, cytosolic dihydroxyacid dehydratase having at least 80% identity to the group consisting of SEQ ID NOs: 304-307, cytosolic 2-isopropylmalate synthase having at least 80% identity to the group consisting of SEQ ID NOs: 308-313, cytosolic isopropylmalate isomerase having at least 80% identity to the group consisting of SEQ ID NOs: 314-315, cytosolic 3-isopropylmalate dehydrogenase having at least 80% identity to the group consisting of SEQ ID NOs: 316-320, and cytosolic βHIV synthase having at least 65% identity to the group consisting of SEQ ID NOS: 1-148.

6. The non-natural microorganism of claim 1, wherein the non-natural microorganism comprises at least one nucleic acid encoding a polypeptide with beta hydroxyisovalerate synthase activity, wherein said polypeptide is at least about 65% identical to at least one polypeptide selected from the group of SEQ ID NOS: 1-148.

7. The non-natural microorganism of claim 1, wherein the non-natural microorganism comprises at least one nucleic acid encoding a polypeptide with beta hydroxyisovalerate synthase activity, wherein said polypeptide is at least about 65% identical to at least one polypeptide selected from SEQ ID NO: 1 or SEQ ID NO: 6.

8. The non-natural microorganism of claim 1, wherein the non-natural microorganism comprises at least one nucleic acid encoding a polypeptide with βHIV synthase activity derived from the group consisting of *Rattus norvegicus*, *Yarrowia lipolytica*, and *Homo sapiens*.

9. The non-natural microorganism of claim 1, wherein the non-natural enzyme comprises one or more modifications or mutations at substrate-specificity positions corresponding to amino acids selected from F371 and SEQ ID NO: 1.

10. The non-natural microorganism of claim 1, wherein the non-natural microorganism comprises a non-natural enzyme, wherein the non-natural enzyme comprises one or more modifications or mutations at substrate-specificity positions selected from the group consisting of leucine, isoleucine or methionine at position 361, leucine, isoleucine, methionine or tryptophan at position 336, tryptophan, tyrosine or isoleucine at position 347, alanine, leucine, isoleucine, methionine or tryptophan at position 364, tyrosine, tryptophan, leucine, isoleucine or methionine at position 368, leucine, isoleucine or methionine at position 371, leucine, isoleucine or methionine at position 362, leucine, valine or methionine at position 227, leucine, valine or methionine at position 252, phenylalanine, tryptophan or methionine at position 224, leucine, valine or methionine at position 289, tryptophan, tyrosine or isoleucine at position 323, leucine, isoleucine, tryptophan or methionine at position 367, phenylalanine, tryptophan or methionine at position 187, phenylalanine, tryptophan or methionine at position 241, isoleucine, methionine or valine at position 363, leucine at position 239, methionine, isoleucine or proline at position 251, methionine, isoleucine or proline at position 265, valine, methionine, isoleucine or leucine at position 226, phenylalanine, leucine, isoleucine or tryptophan at position 212, isoleucine, leucine or methionine at position 217, isoleucine, leucine or methionine at position 228, and leucine at position 210 of SEQ ID NO: 1 or SEQ ID NO: 6.

11. The non-natural microorganism of claim 1, wherein the non-natural microorganism is a prokaryotic microorganism or an eukaryotic microorganism.

12. The non-natural microorganism of claim 1, wherein the non-natural microorganism comprises a yeast or a bacteria.

13. The non-natural microorganism of claim 12, wherein the non-natural microorganism is a yeast selected from the group consisting of *Saccharomyces, Kluyveromyces, Pichia, Issatchenkia, Hansenula,* and *Candida.*

14. The non-natural microorganism of claim 12, wherein the non-natural microorganism is Gram-positive bacteria or a Gram-negative bacteria, the Gram-positive bacteria selected from the group consisting of *Corynebacterium, Lactobacillus, Lactococcus* and *Bacillus,* and the Gram-negative bacteria selected from the group consisting of *Escherichia* and *Pseudomonas.*

15. A method of producing βHIV using a non-natural microorganism, the method comprising:

culturing a non-natural microorganism in the presence of at least one carbon source to produce a fermentation-derived composition comprising βHIV, wherein the non-natural microorganism comprises a non-natural enzyme, wherein the non-natural enzyme has been modified or mutated to increase the ability of the enzyme to preferentially utilize α-ketoisocaproate as its substrate, and wherein the non-natural enzyme comprises one or more modifications or mutations at substrate-specificity positioins corresponding to amino acids from A361, F336, F347, F364, F368, F371, G362, I227, I252, L224, L289, L323, L367, N187, N241, N363, P239, Q251, Q265, S226, V212, V217, V228 and W210, of any of SEQ ID NO: 1 or SEQ ID NO: 6, and wherein the non-natural microorganism is modified or mutated to provide more βHIV than its wild-type parent; and isolating βHIV from the fermentation-derived composition.

16. The method of claim 15, wherein the fermentation-derived composition further comprises at least one fermentation derived component, and wherein the fermentation-derived composition comprising βHIV prior to isolation is substantially devoid of a chemically derived inorganic residue chosen from chloroform, hydrochloric acid, and a halogen derivative.

17. A composition comprising: βHIV produced by a non-natural microorganism, wherein the non-natural microorganism comprises a non-natural enzyme, wherein the non-natural enzyme has been modified or mutated to increase the ability of the enzyme to preferentially utilize α-kaetoisocaproate as its substrate, and wherein the non-natural enzyme comprises one or more modifications or mutations at substrate-specificity positions corresponding to amino acids selected from A361, F336, F347, F364, F368, F371, G362, I227, I252, L224, L289, L323, L367, N187, N241, N363, P239, Q251, Q265, S226, V212, V217, V228 and W210 of any of SEQ ID NO: 1 or SEQ ID NO: 6, wherein the αHIV prior to any isolation or purification process has not been in substantial contact with any halogen-containing component, the halogen-containing component comprising hydrochloric acid or chloroform.

18. The method of producing βHUV using a non-natural microorganism of claim 15, wherein the non-natural microorganism is cultivated in a culture medium containing a feedstock of a carbon source to produce βHIV.

19. The method of producing βHIV using a non-natural microorganism of claim 15, wherein the microorganism is cultivated in a culture medium containing a feedstock of a carbon source to produce βHIV at a yield of at least aboutn 0.1 percent up to 100 percent of theoretical yield.

20. The method of producing βHIV using a non-natural microorganism of claim 15, wherein the microorganism is in contact with a carbon source in a fermenter to produce βHIV, wherein the fermenter introduces sufficient nutrients such that a final βHIV concentration in the fermentation broth is greater than about 10 mg/L.

21. The method of producing βHIV using a non-natural microorganism of claim 15, wherein the microorganism is in contact with a carbon source in a fermenter to produce βHIV, wherein the carbon source is selected from the group consisting of glucose, xylose, arabinose, sucrose, fructose, lactose, glycerol, and mixtures thereof.

22. The method of producing βHIV using a non-natural microorganism of claim 15, wherein the microorganism is in contact with a carbon source in a fermenter to produce a fermentation-derived composition comprising βHIV and at least one fermentation derived impurity.

23. The method of producing βHIV using a non-natural microorganism of claim 15, wherein the microorganism is in contact with a carbon source in a fermenter to produce a fermentation-derived composition comprising βHIV and at least one fermentation derived impurity, wherein the fermentation-derived composition is devoid of any halogen-containing components.

* * * * *